(12) United States Patent
Adams et al.

(10) Patent No.: US 9,587,256 B2
(45) Date of Patent: Mar. 7, 2017

(54) SEQUESTRATION OF CARBON DIOXIDE WITH HYDROGEN TO USEFUL PRODUCTS

(71) Applicants: University of Georgia Research Foundation, Inc., Athens, GA (US); North Carolina State University, Raleigh, NC (US)

(72) Inventors: Michael W. W. Adams, Athens, GA (US); Robert M. Kelly, Cary, NC (US); Aaron B. Hawkins, Durham, NC (US); Angeli Lal Menon, Athens, GA (US); Gina Lynette Pries Lipscomb, Athens, GA (US); Gerrit Jan Schut, Athen, GA (US)

(73) Assignees: University of Georgia Research Foundation, Inc., Athens, GA (US); North Carolina State University, Raleigh, NC (US)

( * ) Notice: Subject to any disclaimer, the term of this patent is extended or adjusted under 35 U.S.C. 154(b) by 0 days.

(21) Appl. No.: 14/426,290

(22) PCT Filed: Sep. 6, 2013

(86) PCT No.: PCT/US2013/058593
§ 371 (c)(1),
(2) Date: Mar. 5, 2015

(87) PCT Pub. No.: WO2014/039879
PCT Pub. Date: Mar. 13, 2014

(65) Prior Publication Data
US 2015/0211030 A1    Jul. 30, 2015

Related U.S. Application Data

(60) Provisional application No. 61/697,654, filed on Sep. 6, 2012.

(51) Int. Cl.
| | |
|---|---|
| *C12N 1/20* | (2006.01) |
| *C12N 1/00* | (2006.01) |
| *C12P 1/00* | (2006.01) |
| *C12P 7/40* | (2006.01) |
| *C12P 7/42* | (2006.01) |
| *C07H 21/04* | (2006.01) |
| *C12N 15/52* | (2006.01) |
| *C12N 9/02* | (2006.01) |
| *C12N 9/00* | (2006.01) |
| *C12N 9/88* | (2006.01) |
| *C12N 9/90* | (2006.01) |

(52) U.S. Cl.
CPC ............... *C12P 7/42* (2013.01); *C12N 9/001* (2013.01); *C12N 9/0008* (2013.01); *C12N 9/0036* (2013.01); *C12N 9/88* (2013.01); *C12N 9/90* (2013.01); *C12N 9/93* (2013.01); *C12N 15/52* (2013.01); *C12Y 102/01018* (2013.01); *C12Y 102/01075* (2013.01); *C12Y 102/01076* (2013.01); *C12Y 103/01084* (2013.01); *C12Y 106/99001* (2013.01); *C12Y 402/01116* (2013.01); *C12Y 501/99001* (2013.01); *C12Y 504/99002* (2013.01); *C12Y 602/01036* (2013.01); *C12Y 604/01002* (2013.01); *C12Y 604/01003* (2013.01); *Y02P 20/52* (2015.11)

(58) Field of Classification Search
None
See application file for complete search history.

(56) References Cited

U.S. PATENT DOCUMENTS

| | | | |
|---|---|---|---|
| 4,703,004 | A | 10/1987 | Hopp et al. |
| 4,782,137 | A | 11/1988 | Hopp et al. |
| 5,594,115 | A | 1/1997 | Sharma |
| 5,872,238 | A | 2/1999 | Weber et al. |
| 5,935,824 | A | 8/1999 | Sgarlato |
| 7,642,405 | B2 | 1/2010 | Lee |
| 7,785,861 | B2 | 8/2010 | Devroe et al. |
| 7,794,969 | B1 | 9/2010 | Reppas et al. |
| 7,803,589 | B2 | 9/2010 | Burk et al. |
| 8,048,624 | B1 | 11/2011 | Lynch |

(Continued)

FOREIGN PATENT DOCUMENTS

WO    WO 2013/067326 A1    5/2013

OTHER PUBLICATIONS

Berg et al. A 3-Hydroxypropionate/4-Hydroxybutyrate Autotrophic Carbon Dioxide Assimilation Pathway in Archaea, Science (2007), 318: 1782-1786.*

(Continued)

*Primary Examiner* — Iqbal H Chowdhury
(74) *Attorney, Agent, or Firm* — Mueting, Raasch & Gebhardt, P.A.

(57) ABSTRACT

Provided herein are genetically engineered microbes that include at least a portion of a carbon fixation pathway, and in one embodiment, use molecular hydrogen to drive carbon dioxide fixation. In one embodiment, the genetically engineered microbe is modified to convert acetyl CoA, molecular hydrogen, and carbon dioxide to 3-hydroxypropionate, 4-hydroxybutyrate, acetyl CoA, or the combination thereof at levels greater than a control microbe. Other products may also be produced. Also provided herein are cell free compositions that convert acetyl CoA, molecular hydrogen, and carbon dioxide to 3-hydroxypropionate, 4-hydroxybutyrate, acetyl CoA, or the combination thereof. Also provided herein are methods of using the genetically engineered microbes and the cell free compositions.

10 Claims, 157 Drawing Sheets

(56) References Cited

U.S. PATENT DOCUMENTS

| | | |
|---|---|---|
| 8,278,087 B2 | 10/2012 | Remmereit et al. |
| 8,420,358 B2 | 4/2013 | Claassen et al. |
| 8,420,375 B2 | 4/2013 | Osterhout et al. |
| 8,435,770 B2 | 5/2013 | Hogsett et al. |
| 8,470,566 B2 | 6/2013 | Trawick et al. |
| 8,486,687 B2 | 7/2013 | Atkinson et al. |
| 8,497,128 B2 | 7/2013 | Van Kranenburg et al. |
| 2003/0162273 A1 | 8/2003 | Melis et al. |
| 2005/0014239 A1 | 1/2005 | Melis et al. |
| 2005/0064577 A1 | 3/2005 | Berzin |
| 2007/0269864 A1 | 11/2007 | Lee |
| 2008/0127364 A1 | 5/2008 | Lee |
| 2009/0081257 A1 | 3/2009 | Maier et al. |
| 2009/0203070 A1 | 8/2009 | Devroe et al. |
| 2010/0068773 A1 | 3/2010 | Marx et al. |
| 2010/0120104 A1 | 5/2010 | Reed |
| 2010/0239923 A1 | 9/2010 | Lee |
| 2010/0242345 A1 | 9/2010 | Keasling et al. |
| 2011/0020875 A1 | 1/2011 | Adams et al. |
| 2011/0244575 A1 | 10/2011 | Lipscomb |
| 2012/0135411 A1 | 5/2012 | Lipscomb et al. |

OTHER PUBLICATIONS

International Search Report and Written Opinion for PCT/US2013/058593, issued by the Korean Intellectual Property Office on Dec. 23, 2013; 15 pages.
International Preliminary Report on Patentability for PCT/US2013/058593, filed issued Mar. 19, 2015; 11 pages.
Adams et al., "Chapter 21. Transcriptomics, Proteomics and Structural Genomics of *Pyrococcus furiosus*" in *Archaea: Evolution, Physiology, and Molecular Biology*. Garrett and Klenk (Ed.) Blackwell Publishing Ltd, Malden, MA, USA; Nov. 30, 2007. Cover page, publisher's page, and pp. 239-247.
Adams et al., "The Southeast Collaboratory for Structural Genomics: a high-throughput gene to structure factory," *Acc Chem Res*; 2003;36:191-198.
Adams, "The structure and mechanism of iron-hydrogenases," *Biochim Biophys Acta*, 1990; 1020:115-45.
Adams et al., "Hydrogenase," *Biochim Biophys Acta*, 1980; 594:105-76.
Adams et al., "Organometallic iron: the key to biological hydrogen metabolism," *Curr Opin Chem Biol*, 2000; 4:214-20.
Adams and Kelly, "Hydrogen-dependent Conversion of Carbon Dioxide to Liquid Electrofuels by Extremely Thermophilic Archaea," Powerpoint Presentation, DOE ARPA-E Electrofuels, NC State University and The University of Georgia, 15 slides. Project Term Jul. 1, 2010 to Dec. 31, 2014.
Adams and Kelly, "H2-driven CO2 Fixation by Extremely Thermoacidophilic Archaea," *ARPA-E Workshop on Novel Approaches to Direct Solar Fuels*, Oct. 21, 2009, Arlington, VA.
Ahlborn et al. "Identification of eggshell membrane proteins and purification of ovotransferrin and beta-nagase from hen egg white," *Protein J*, 2006; 25:71-81.
Alber et al., "3-Hydroxypropionyl-coenzyme A synthetase from *Metallosphaera sedula*, an enzyme involved in autotrophic $CO_2$ fixation," *J Bacteriol*, Feb. 15, 2008;190(4):1383-1389.
Alber et al., "Malonyl-CoA reductase in the modified 3-hydroxypropionate cycle for autotrophic carbon fixation in archaeal *Metallosphaera* and *Sulfolobus*sp.," *J Bacteriol*, 2006;188:8551-8559.
Albracht, "Nickel hydrogenases: in search of the active site," *Biochim Biophys Acta*, 1994; 1188:167-204.
Aono et al., "A novel and remarkably thermostable ferredoxin from the hyperthermophilic archaebacterium *Pyrococcus furiosus*," *J Bacteriol*, 1989; 171:3433-9.
Atsumi et al., "Metabolic engineering of *Escherichia coli* for 1-butanol production," *Metab Eng*, 2008;10:305-311.
Auernik and Kelly, "Physiological Versatility of the Extremely Themoacidophilic Achaeon *Metallosphaera sedula*, Supported by Transcriptomic Analysis of Heterotrophic, Autotrophic, and Mixotrophic Growth," *Appl Environ Microbiol*, Feb. 2010;76(3):931-935.
Auernik and Kelly, "Identification of components of electron transport chains in the extremely thermoacidophilic crenarchaeon *Metallosphaera sedula* through iron and sulfur compound oxidation transcriptomes," *Appl Environ Microbiol*, Dec. 2008;74(24):7723-7732.
Auernik and Kelly, "Impact of molecular hydrogen on chalcopyrite bioleaching by the extremely thermoacidophilic archaeon Metallosphaera sedula" *Appl Environ Microbiol*, Apr. 2010; 76(8):2668-2672.
Auernik et al., "Life in hot acid: Pathway analyses in thermoacidophilic archaea," *Curr Opin Biotechnol*, 2008;19:445-453.
Auernik et al., "The genome sequence of the metal-mobilizing, extremely thermoacidophilic archaeon *Metallosphaera sedula* provides insights into bioleaching-associated metabolism," *Appl Environ Microbiol*, 2008;74:682-92.
Bagley et al., "Infrared-detectable groups sense changes in charge density on the nickel center in hydrogenase from *Chromatium vinosum*," *Biochemistry*, 1995;34:5527-35.
Baker-Austin et al., Life in acid: pH homeostasis in acidophiles, *Trends Microbiol*, 2007;15:165-171.
Bar-Even et al., *Biochim Biophys Acta*, 2012;1817:1646-1659.
Barrangou et al., "Global analysis of carbohydrate utilization by *Lactobacillus acidophilus* using DNA microarrays," *Proc Natl Acad Sci USA*, 2006; 103:3816-3821.
Bascones et al., "Generation of new hydrogen-recycling *Rhizobiaceae* strains by introduction of a novel hup minitransposon," *Appl Environ Microbiol*, 2000; 66:4292-9.
Basen et al., "Engineering a Hyperthermophilic Archaeon for Temperature-Dependent Product Formation," *MBiol*, 2012;3(2):e00053-00012.
Bathe et al., "Ferrous iron- and sulfur-induced genes in *Sulfolobus metallicus*," *Appl. Environ. Microbiol*, 2007;73:2491-2497.
Bell et al., "Transcriptional Regulation of an Archaeal Operon In Vivo and In Vitro" *Mol Cell*, 1999; 4:971-982.
Bell et al., "Orientation of the transcription preinitiation complex in Archaea" *PNAS USA*, 1999;96:13662-13667.
Berg et al., "Autotrophic carbon fixation in archaea" *Nat Rev Microbiol*, 2010;8:447-460.
Berg, *Appl Environ Microbiol*, 2011;77:1925-1936.
Berg et al., "A 3-Hydroxypropionate/4-Hydroxybutyrate Autotrophic Carbon Dioxide Assimilation Pathway in Archaea," *Science*, Dec. 14, 2007;318:1782-1786.
Blake et al., "Comparison of the X-ray structure of native rubredoxin from *Pyrococcus furiosus* with the NMR structure of the zinc-substituted protein," *Protein Sci*, 1992;1:1522-5.
Blake et al., "Solution-state structure by NMR of zinc-substituted rubredoxin from the marine hyperthermophilic archaebacterium *Pyrococcus furiosus*," Protein Sci, 1992; 1:1508-21.
Blamey and Adams, "Purification and characterization of pyruvate ferredoxin oxidoreductase from the hyperthermophilic archaeon *Pyrococcus furiosus*," *Biochim Biophys Acta*, 1993;1161:19-27.
Blaustein, "Can Biology Transform our Energy Future?" *BioScience*, Feb. 2012;62(2):115-119.
Blokesch et al., "The complex between hydrogenase-maturation proteins HypC and HypD is an intermediate in the supply of cyanide to the active site iron of [NiFe]-hydrogenases," *J Mol Biol*, 2004; 344:155-67.
Blokesch and Bock, "Maturation of [NiFe]-hydrogenases in *Escherichia coli*: the HypC cycle," *J Mol Biol*, 2002; 324:287-96.
Blokesch et al., "Analysis of the transcarbamoylation-dehydration reaction catalyzed by the hydrogenase maturation proteins HypF and HypE," *Eur J Biochem*, 2004; 271:3428-36.
Blokesch et al., "Metal insertion into NiFe-hydrogenases," *Biochem Soc Trans*, 2002; 30:674-80.
Blokesch et al., "HybF, a zinc-containing protein involved in NiFe hydrogenase maturation," *J Bacteriol*, 2004; 186:2603-11.
Blumer-Schuette, et al., "Extremely thermophilic microorganisms for biomass conversion: status and prospects," *Curr. Opin. Biotechnol.*, 2008; 19:1-8.

(56) References Cited

OTHER PUBLICATIONS

Bock et al., "Maturation of hydrogenases," *Adv Microb Physiol*, 2006; 51:1-71.

Boucher et al., "Origins and Evolution of Isoprenoid Lipid Biosynthesis in Archaea" *Mol Microbiol*, 2004; 52:515-527.

Bowie et al., "Deciphering the Message in Protein Sequences: Tolerance to Amino Acid Substitutions" *Science*, 1990; 247:1306-1310.

Brasen et al., "AMP-forming acetyl-CoA synthetase from the extremely halophilic archaeon *Haloarcula marismortui* : purification, identification and expression of the encoding gene, and phylogenetic affiliation" *Extremophiles*, 2005; 9:355-365.

Brasen et al., "A novel octameric AMP-forming acetyl-CoA synthetase from the hyperthermophilic crenarchaeon *Pyrobaculum aerophilum*" *FEBS Letters*, 2005;579:477-482.

Breeze, "An improved method using acetyl-coenzyme A regeneration for the enzymic inactivation of aminoglycosides prior to sterility testing," *J Appl Microbiol*, 2008;53 :277-284.

Bridger et al., "Genome Sequencing of a Genetically Tractable *Pyrococcus furiosus* Strain Reveals a Highly Dynamic Genome" *J Bacteriol*, 2012;194(15):4097-4106.

Brock et al., "Sulfolobus: A New Genus of Sulfer-Oxidizing Bacteria Living at Low pH and High Temperature" *Arch Microbiol*, 1972; 84:54-68.

Bryant et al., "Characterization of hydrogenase from the hyperthermophilic archaebacterium, *Pyrococcus furiosus*," *J Biol Chem*, 1989; 264:5070-9.

Buckel et al., "Radical Enzymes in Anaerobes" *Annu Rev Microbiol*, 2006; 60:27-49.

Burggraf et al., "A phylogenetic analysis of *Aquifex pyrophilus*," *Syst Appl Microbiol*, 1992; 15:352-356.

Cacciapuoti et al., "The first agmatine/cadaverine aminopropyl transferase: biochemical and structural characterization of an enzyme involved in polyamine biosynthesis in the hyperthermophilic archaeon *Pyrococcus furiosus*," *J Bacteriol*, 2007; 189:6057-6067.

Cammack et al., Hydrogen as a fuel: learning from nature. Taylor & Francis, New York, 2001. 14 pages.

Chan et al., "Structure of a hyperthermophilic tungstopterin enzyme, aldehyde ferredoxin oxidoreductase," *Science*, 1995; 267:1463-9.

Chandrayan et al., "Engineering Hyperthermophilic Archaeon *Pyrococcus furiosus* to Overproduce Its Cytoplasmic [NiFe]-Hydrogenase," *J Biol Chem*, Jan. 27, 2012;287(5):3257-3264.

Chen et al., "Acetone butanol isopropanol production by *Clostridium-beijerinckii* (synonym, *Clostridiumbutylicum*)," *Biotechnol Lett*, 1986; 8:371-376.

Chou et al., "Hydrogenesis in hyperthermophilic microorganisms: Implications for biofuels," Metabolic Eng., Nov. 2008;10(6):394-404.

Chou et al., "Impact of glucoside substrate linkage and elemental sulfur on bioenergetics and hydrogen production by the hyperthermophilic archaeon *Pyrococcus furiosus*," *Appl Environ Microbiol*, 2007; 73:6842-53.

Chung et al., "The *Escherichia coli* metal-binding chaperone SlyD interacts with the large subunit of [NiFe]-hydrogenase 3" *FEBS Lett.*, 2010;585:291-294.

Comfort et al., "Functional genomics-based identification and characterization of novel α-glucan acting glycosyl hydrolases in the hyperthermophilic archaeon *Pyrococcus furiosus*," *Appl Environ Microbiol*, Feb. 2008; 74(4):1281-1283.

Comfort et al., "Biochemical analysis of *Thermotoga maritima* GH36 α-galactosidase (*Tm*GalA) confirms the mechanistic commonality of clan GH-D glycoside hydrolases," *Biochemistry*, 2007; 46:3319-3330.

Comfort et al., "Strategic biocatalysis with hyperthermophilic enzymes," *Green Chem*, 2004; 6:459-465.

Conner et al., "Microbial production of advanced transportation fuels in non-natural hosts," *Curr Opinion Biotechnol*, 2009;20:307-315.

Conners et al., "Microbial biochemistry, physiology, ecology and biotechnology of hyperthermophilic *Thermotoga* species," FEMS Microbiol. Rev., 2006; 30:872-905.

Conners et al., "An expression-driven approach to the prediction of carbohydrate transport and utilization in the hyperthermophilic bacterium *Thermotoga maritima*," *J Bacteriol*, 2005; 187:7267-7282.

Day et al., "X-ray crystal structures of the oxidized and reduced forms of the rubredoxin from the marine hyperthermophilic archaebacterium *Pyrococcus furiosus*," *Protein Sci*, 1992; 1:1494-507.

Dopson et al., "Growth in sulfidic mineral environments: metal resistance mechanisms in acidophilic micro-organisms," *Microbiology*, 2003; 149:1959-70.

Durst et al., "Phenacyl Esters of Fatty Acids via Crown Ether Catalysts for Enhanced Ultraviolet Detection in Liquid Chromatography" *Anal Chem*, 1975;47:1797-1801.

Eisenreich et al., "Retrobiosynthetic analysis of carbon fixation in the phototrophic eubacterium *Chloroflexus aurantiacus*," *Eur J Biochem*, 1993; 215:619-32.

Epting et al., "Influence of divalent metal cations on the structural thermostability and thermal inactivation kinetics of class II xylose isomerases," *FEBS J*, 2005; 272:1454-1464.

Estlemann et al., "Labeling and Enzyme Studies of the Central Carbon Metabolism in *Metallosphaera sedula*" *J Bacteriol*, 2011; 193:1191-1200.

Ettema et al., "Molecular characterization of a conserved archaeal copper resistance (cop) gene cluster and its copper-responsive regulator in *Sulfolobus solfataricus* P2," *Microbiology*, 2006; 152:1969-79.

Farkas et al., "Recombinogenic Properties of *Pyrococcus furiosus* Strain COM1 Enable Rapid Selection of Targeted Mutants" *Appl Environ Microb*, 12; 78(13):4669-76.

Fiala & Stetter, "*Pyrococcus furiosus* sp. nov. represents a novel genus of marine heterotropic archaebacteria growing optimally at 100° C.," *Arch Microbiol*, 1986;145:56-61.

Forzi et al., "Maturation of [NiFe]-hydrogenases in *Escherichia coli*," *Biometals*, 2007; 20:565-78.

Friedrich and Schwartz, "Molecular biology of hydrogen utilization in aerobic chemolithotrophs," *Annu Rev Microbiol*, 1993; 47:351-83.

Fuchs et al., "Bioenergetics and autotrophic carbon metabolism of chemolithotrophic archaebacterial," *Biochem Soc Symp*, 1992; 58:23-39.

Fuchs et al., "*Metallosphaera prunae*, sp. nov., a novel metal-mobilizing, thermoacidophilic archaeum, isolated from a uranium mine in Germany," *System Appl Microbiol*, 1995; 18:560-566.

Garcin et al., "The crystal structure of a reduced [NiFeSe] hydrogenase provides an image of the activated catalytic center," *Structure*, 1999; 7:557-66.

Gehrke et al., "Importance of extracellular polymeric substances from *Thiobacillus ferrooxidans* for bioleaching," *Appl Environ Microbiol*, 1998; 64:2743-2747.

Georgieva and Ahring, "Evaluation of continuous ethanol fermentation of dilute-acid corn stover hydrolysate using thermophilic anaerobic bacterium *Thermoanaerobacter* BG1L1," *Appl Microbiol Biotechnol*, 2007; 77:61-68.

Georgieva et al., "Effect of temperature on ethanol tolerance of a thermophilic anaerobic ethanol producer *Thermoanaerobacter* A10: modeling and simulation," *Biotechnol Bioeng*, 2007; 98:1161-1170.

Gerhardt et al., "Fermentation of 4-aminobutyrate by *Clostridium aminobutyricum*: cloning of two genes involved in the formation and dehydration of 4-hydroxybutyryl-CoA" *Arch Microbiol*, 2000; 174:189-99.

Gerwe et al., "Structural and transcriptional analyses of a purine nucleotide-binding protein from *Pyrococcus furiosus*: a component of a novel, membrane-bound multiprotein complex unique to this hyperthermophilic archaeon," *J Struct Funct Genomics*, 2007; 8:1-10.

Glasemacher et al., "Purification and properties of acetyl-CoA synthetase (ADP-forming), an archaeal enzyme of acetate formation and ATP synthesis, from the hyperthermophile *Pyrococcus furiosus*" *Eur J Biochem*, 1997; 244:561-67.

(56) References Cited

OTHER PUBLICATIONS

Gold, "The deep, hot biosphere" *PNAS USA*, 1992; 89:6045-9.
Gray et al., "Microorganisms, Extremely Thermophilic" in *Encyclopedia of Industrial Biotechnology: Bioprocess, Bioseparation, and Cell Technology*, 2$^{nd}$ edition, M.C. Flickinger, Editor, John Wiley and Sons, NY, 2010. Cover page, title page, table of contents, and pp. 3481-3499.
Gregor and Pfeifer, "In vivo analyses of constitutive and regulated promoters in halophilic archaea" *Microbiology*, 2005; 151:25-33.
Grogan, "Phenotypic Characterization of the Archaebacterial Genus *Sulfolobus*: Comparison of Five Wild-Type Strains" *J Bacteriol*, 1989; 171:6710-9.
Grunden et al., "Expression of extremophilic proteins," *Expression Technologies: Current Status and Future Trends*, F. Baneyx (ed.);2004; Horizon Scientific; Cover page, title page and table of contents; pgs.
Guiral et al., "A membrane-bound multienzyme, hydrogen-oxidizing, and sulfur-reducing complex from the hyperthermophilic bacterium *Aquifex aeolicus*," *J Biol Chem*, 2005; 280:42004-15.
Gulick et al., "The 1.75 Å Crystal Structure of Acetyl-CoA Synthetase Bound to Adenosine-5'-propylphosphate and Coenzyme A" *Biochemistry*, 2003; 42:2866-2873.
Gulick et al., "Crystal Structure of 4-Chlorobenzoate:CoA Ligase/Synthetase in the Unliganded and Aryl Substrate-Bound States" *Biochemistry*, 2004; 43:8670-8679.
Gulick et al., "Conformational Dynamics in the Acyl-CoA Synthetases, Adenylation Domains of Nonribosomal Peptide Synthetases, and Firefly Luciferase" *ACS Chemical Biol*, 2009; 4:811-827.
Guo et al., "Genome Analyses of Icelandic Strains of *Sulfolobus islandicus*, Model Organisms for Genetic and Virus-Host Interaction Studies" *J Bacteriol*, 2011; 193:1672-1680.e26569.
Hallam et al., "Pathways of carbon assimilation and ammonia oxidation suggested by environmental genomic analyses of marine Crenarchaeota," *PLoS Biol*, 2006; 4:e95.
Han et al., "Epimerase (Msed_0639) and mutase (Msed_0638) and Msed_2055) convert (S)-methylmalonyl-coenzyme A (CoA) to succinyl-CoA in the Metallosphaera sedula 3-hydroxypropionate/4-hydroxybutyrate cycle," *Appln Environ Microbiol*, Jun. 29, 2012;78(17):6194-6202.
Han et al., "Acquired thermotolerance and 'stressed phase' growth of the extremely thermoacidophilic archaeon *Metallosphaera sedula* in continuous culture," *Appl Environ Microbiol*, 1997; 63:2391-2396.
Han and Kelly, Biooxidation capacity of the extremely thermoacidophilic archaeon *Metallosphaera sedula* under bioenergetic challenge, *Biotechnol Bioeng* 1997; 58:617-624.
Hanai et al., "Engineered synthetic pathway for isopropanol production in *Escherichia coli*," *Appl Environ Microbiol*, 2007; 73 :7814-8.
Happe et al., "Biological activation of hydrogen," *Nature*, 1997; 385:126.
Harris et al., "Enzymes, Extremely Thermophilic," In *Encyclopedia of Industrial Biotechnology: Bioprocess, Bioseparation, and Cell Technology*, 2$^{nd}$ edition, M.C. Flickinger, Editor, John Wiley and Sons, NY, Apr. 15, 2010, 1-17pgs.
Haugh, J.M., and R.M. Kelly. 2007. Biochemical/Biomolecular engineering. McGraw-Hill Encyclopedia of Science and Technology, 10th Ed. 7 pages.
Hawkins et al., "Extremely Thermophilic Routes to Microbial Electrofuels," *ACS Catal*, 2011; 1:1043-1050.
Hawkins et al., "Biological conversion of carbon dioxide and hydrogen into liquid fuels and industrial chemicals," *Curr Opin Biotechnology*, 2013; 24:376-384.
Hawkins et al., "Role of 4-Hydroxybutyrate-CoA Synthetase in the $CO_2$ Fixation Cycle in Thermoacidophilic Archaea," *J Biol Chem*, 2013;288(6):4012-4022.
Herter et al., "Autotrophic CO(2) fixation by *Chloroflexus aurantiacus*: study of glyoxylate formation and assimilation via the 3-hydroxypropionate cycle," *J Bacteriol*, 2001; 183 :4305-16.
Herter et al., "A bicyclic autotrophic CO2 fixation pathway in *Chloroflexus aurantiacus*," *J Biol Chem*, 2002; 277:20277-83.
Hicks et al., *Pyrococcus furiosus* Protease I (PfpI) in Handbook of Proteolytic Enzymes, F. Woessner, N. Rawlings, A. Barrett, eds., Academic Press Limited, London, 2004; pp. 1393-1395.
Higuchi et al., "Removal of the bridging ligand atom at the Ni—Fe active site of [NiFe] hydrogenase upon reduction with H2, as revealed by X-ray structure analysis at 1.4 A resolution" *Structure*, 1999 7:549-56.
Higuchi et al., "Unusual ligand structure in Ni—Fe active center and an additional Mg site in hydrogenase revealed by high resolution X-ray structure analysis," *Structure*, 1997;5:1671-80.
Holo and Sirevag, "Autotrophic growth and CO2 fixation of *Chloroflexus aurantiacus*," *Arch Microbiol*, 1986; 145:173-180.
Holo and Sirevag, "*Chloroflexus auranticus* secretes 3-hydroxybutyrate, a possible intermediate in assimilation of $CO_2$ and acetate," *Arch Microbiol*, 1989; 151.
Hopkins et al., "Homologous Expression of a Subcomplex of *Pyrococcus furiosus* Hydrogenase that Interacts with Pyruvate Ferredoxin Oxidoreductase" *PLoS One*, 2011; 6(10):e26569.
Horton et al., "Engineering hybrid genes without the use of restriction enzymes: gene splicing by overlap extension" *Gene*, 1989; 77(1):61-68.
Huber et al., "*Metallosphaera sedula* gen. and sp. nov. represents a new genus of aerobic, metal-mobilizing, thermoacidophilic archaebacteria," *Syst. Appl. Microbiol*, 1989; 12:38-47.
Huber et al., "A dicarboxylate/4-hydroxybutyrate autotrophic carbon assimilation cycle in the hyperthermophilic Archaeum *Ignicoccus hospitalis*," *PNAS USA*, 2008;105:7851-7856.
Huber and Prangishvili, "Sulfolobales," in *Prokaryotes*, 3$^{rd}$ Edition, Dworkin (Ed.) Springer, New York, NY; 2006. Chapter 3; Cover page, publisher's page, and pp. 23-51.
Hugler et al., "Autotrophic CO2 fixation pathways in archaea (Crenarchaeota)," *Arch Microbiol*, 2003;179:160-173.
Hugler et al., "Characterization of acetyl-CoA/propionyl-CoA carboxylase in *Metallosphaera sedula*. Carboxylating enzyme in the 3-hydroxypropionate cycle for autotrophic carbon fixation," *Eur J Biochem*, 2003;270(4):736-744.
Hugler and Fuchs, Assaying for the 3-hydroxypropionate cycle of carbon fixation. Methods Enzymol, 2005; 397:212-21.
Ingram-Smith and Smith, "AMP-forming acetyl-CoA synthetases in Archaea show unexpected diversity in substrate utilization" *Archaea*, 2007; 2:95-107.
Ingram-Smith et al., "Characterization of the Acyl Substrate Binding Pocket of Acetyl-CoA Synthetase" *Biochemistry*, 2006;45:11482-11490.
Jenney et al., "High-throughput production of *Pyrococcus furiosus* proteins: considerations for metalloproteins," *J Synchrotron Radiat*, 2005; 12:8-12.
Jenney et al., "Chapter 20—Functional genomics," *Archaea*. ASM Press, Cavicchioli R (ed) Washington, DC, 2007; p. 434-462.
Jogl and Tong, "Crystal Structure of Yeast Acetyl-Coenzyme A Synthetase in Complex with AMP" *Biochemistry*, 2004; 43:1425-1431.
Johnson et al., "Functional genomics-based studies of the microbial ecology of hyperthermophilic microorganisms," *Biochem Soc Trans*, 2004; 32:188-192.
Johnson et al., "Population density-dependent regulation of exopolysaccharide formation in the hyperthermophilic bacterium *Thermotoga maritima*," *Mol Microbiol*, 2005; 55:664-674.
Johnson et al., "*Thermotoga maritima* phenotype is impacted by symbiotic interaction with *Methanococcus jannaschii* in hyperthermophilic co-culture," *Appl Environ Microbiol*, 2006; 72:811-818.
Jojima et al., "Production of isopropanol by metabolically engineered *Escherichia coli*," *Appl Microbiol Biotechnol*, 2008; 77:1219-24.
Kaczowkaa et al., "Probing the stability of native and activated forms of α2-macroglobulin," *Int J Biol Macromol*, 2007; 42:62-67.
Kanai et al., "Identification of the Phr-dependent heat shock regulon in the hyperthermophilic archaeon, *Thermococcus kodakaraensis*," *J Biochem*, 2009; 147:361-70.

(56) References Cited

OTHER PUBLICATIONS

Keller et al., "Exploiting microbial hyperthermophilicity to produce an industrial chemical, using hydrogen and carbon dioxide," Proc Natl Acad Sci USA, Mar. 25, 2013;110(15):5840-5845.

Kelly and Shockley, "Part VI: Applications of Genomic Data: Chapter 25—Enzyme Discovery and Microbial Genomics," *Microbial Genomics*. 2004, C.M. Fraser, T. Read, and K.E. Nelson, Eds., Humana Press, Inc., Totowa, NJ., p. 461-483.

Kelley, et al., "Structure of the hypothetical protein PF0899 from *Pyrococcus furiosus* at 1.85 A resolution," *Acta Crystallogr Sect F Struct Biol Cryst Commun*, 2007; 63:549-52.

Kletzin et al., "Dissimilatory Oxidation and Reduction of Elemental Sulfur in Thermophilic Archaea" *J Bioenergetics and Biomembranes*, 2004; 36:77-91.

Kockelkorn and Fuchs, "Malonic semialdehyde reductase, succinic semialdehyde reductase, and succinyl-coenzyme A reductase from *Metallosphaera sedula*: enzymes of the autotrophic 3-hydroxypropionate/4-hydroxybutyrate cycle in Sulfolobales," *J Bacteriol*, 2009;191:6352-6362.

Koga and Morii, "Biosynthesis of Ether-Type Polar Lipids in Archaea and Evolutionary Considerations" *Microbiol Mol Biol Rev*, 2007;71:97-120.

Kreysa, "Climate Protection by an Alternative Use of Methane—The Carbon Moratorium" *ChemSusChem*, 2009; 2(1):49-55.

Lal, R., "Carbon sequestration," *Phil Trans R Soc B*, 2008; 363:815-830.

Lamle et al., "Electrochemical potential-step investigations of the aerobic interconversions of [NiFe]-hydrogenase from *Allochromatium vinosum*: insights into the puzzling difference between unready and ready oxidized inactive states," *J Am Chem Soc*, 2004; 126:14899-909.

Laska, "Membrane-bound hydrogenase and sulfur reductase of the hyperthermophilic and acidophilic archaeon *Acidianus ambivalens*," *Microbiol.*, 2003;149:2357-2371.

Leach et al., "The role of complex formation between the *Escherichia coli* hydrogenase accessory factors HypB and SlyD," *J Biol Chem*, 2007;282:16177-86.

Lee et al al., "Fermentative butanol production by Clostridia," *Biotechnol Bioeng*, 2008; 101:209-28.

Lee et al., "Transcriptional and biochemical analysis of starch metabolism in the hyperthermophilic archaeon *Pyrococcus furiosus*," *J Bacteriol*, 2006; 188:2115-2125.

Lee et al., "Metabolic engineering of microorganisms for biofuels production: from bugs to synthetic biology to fuels," *Curr Opin Biotechnol*, 2008;19:556-563.

Lenz et al., "Requirements for heterologous production of a complex metalloenzyme: the membrane-bound [NiFe] hydrogenase," *J Bacteriol*, 2005; 187:6590-5.

Lipscomb et al., "Natural Competence in the Hyperthermophilic Archaeon *Pyrococcus furiosus*, Facilitates Genetic Manipulation: Construction of Markerless Deletions of Genes Encoding the Two Cytoplasmic Hydrogenases," *Appl. Environ Microbiol.*, Apr. 2011;77(7):2232-2238.

Lipscomb et al., "SurR: a transcriptional activator and repressor controlling hydrogen and elemental Sulphur metabolism in *Pyrococcus furiosus*," *Mol. Microbiol*, Jan. 2009;71(2):332-349.

Litynski et al., "The United States Department of Energy's Regional Carbon Sequestration Partnerships Program Validation Phase," *Envrionment International*, 2008; 34:127-138.

Lucas et al., "Construction of a shuttle vector for, and spheroplast transformation of, the hyperthermophilic archaeon *Pyrococcus abyssi*," *Appl Environ Microbiol*, 2002; 68:5528-36.

Luyben, Control of the heterogeneous azeotropic n-butanol/water distillation systems, *Energy & Fuels*, 2008; 22:4249-4258.

Ma, K., and M. W. Adams, "Hydrogenases I and II from *Pyrococcus furiosus*," *Methods Enzymol*, 2001; 331:208-16.

Ma et al., "Purification and characterization of NADP-specific alcohol dehydrogenase and glutamate dehydrogenase from the hyperthermophilic archaeon *Thermococcus litoralis*," *Appl Environ Microbiol*, 1994; 60:562-568.

Ma et al., "Hydrogenase of the hyperthermophile *Pyrococcus furiosus* is an elemental sulfur reductase or sulfhydrogenase: evidence for a sulfur-reducing hydrogenase ancestor," *Proc Natl Acad Sci USA*, 1993; 90:5341-4.

Ma and Adams, "Sulfide dehydrogenase from the hyperthermophilic archaeon *Pyrococcus furiosus*: a new multifunctional enzyme involved in the reduction of elemental sulfur," *J Bacteriol*, 1994; 176:6509-17.

Ma et al., "Characterization of hydrogenase II from the hyperthermophilic archaeon *Pyrococcus furiosus* and assessment of its role in sulfur reduction," *J Bacteriol*, 2000; 182:1864-71.

Madding et al., "Role of β1 protein in the function and stability of the 20S proteasome from the hyperthermophilic archaeon *Pyrococcus furiosus*," *J Bacteriol*, 2007; 189:583-590.

Magnuson, K., S. Jackowski, C. O. Rock, and J. E. Cronan, Jr. 1993. Regulation of fatty acid biosynthesis in *Escherichia coli*. Microbiol Rev 57:522-42.

Mahammad et al., "Rheological properties of guar galactomannan solutions during hydrolysis with galactomannanase and α-galactosidase enzyme mixtures," *Biomacromolecules*, 2007; 8:949-956.

Martins et al., "Crystal structure of 4-hydroxybutyryl-CoA dehydratase: Radical catalysis involving a [4Fe—4S] cluster and Flavin," *Proc Natl Acad Sci USA*, Nov. 2, 2004;101(44):15645-15649.

Massanz et al., "Subforms and in vitro reconstitution of the NAD-reducing hydrogenase of *Alcaligenes eutrophus*," *J Bacteriol*, 1998;180:1023-9.

Matsumi et al., "Disruption of a sugar transporter gene cluster in a hyperthermophilic archaeon using a host-marker system based on antibiotic resistance," *J Bacteriol*, 2007; 189:2683-91.

Matsumi et al., "Isoprenoid biosynthesis in Archaea e Biochemical and evolutionary Implications" *Res Microbiol*, 2011; 162:39-52.

Matsushika et al., "Ethanol production from xylose in engineered *Saccharomyces cerevisiae* strains: current state and perspectives," *Appl Microbiol Biotechnol*, 2009; 84:37-53.

Mayer et al., "Structure determination of a new protein from backbone-centered NMR data and NMR-assisted structure prediction," *Proteins*, 2006; 65:480-9.

McGuffey et al., "Denaturation and aggregation of 3 □-lactalbumin," *J Agricult Food Chem*, 2005; 53:3182-3190.

Menendez et al., "Presence of acetyl coenzyme A (CoA) carboxylase and propionyl-CoA carboxylase in autotrophic Crenarchaeota and indication for operation of a 3-hydroxypropionate cycle in autotrophic carbon fixation," *J Bacteriol*, 1999;181:1088-1098.

Meyer, J. "[FeFe] hydrogenases and their evolution: a genomic perspective," *Cell Mol Life Sci*, 2007;64:1063-84.

Michel and Kelly, "Chapter 20. The Archaeal 20S Proteasome: A Simple and Thermostable Model System for the Core Particle (CP)," in *Thermophiles: Biology and Technology at High Temperatures*, 2007; FT Robb, Editors. Taylor and Francis Group Publishers.

Miwa et al., "High-performance liquid chromatographic determination of mono-,poly- and hydroxycarboxylic acids in foods and beverages as their 2- nitrophenylhydrazides" *J of Chromatoraphy*, 2000;A 881(1-2):365-385.

Montero et al., "Co-location of genes encoding tRNA-mRNA hybrid and a putative signaling peptide on complementary strands in the genome of the hyperthermophilic bacterium *Thermotoga maritima*," *J Bacteriol*, 2006; 188:6802-6807.

Montero et al., "Response of wild-type and resistant strains of the hyperthermophilic bacterium *Thermotoga maritima* to chloramphenicol challenge," *Appl Environ Microbiol*, 2007; 73:5058-5065.

Muh et al., "4-Hydroxybutyryl-CoA Dehydratase from *Clostridium aminobutyricum*: Characterization of FAD and Iron-Sulfur Clusters Involved in an Overall Non-Redox Reaction" *Biochemistry*, 1996; 35:11710-18.

Nather et al. "Flagella of *Pyrococcus furiosus*: multifunctional organelles, made for swimming, adhesion to various surfaces, and cell-cell contacts," *J Bacteriol*, 2006; 188:6915-23.

National Center for Biotechnology Information, National Library of Medicine, National Institutes of Health, GenBank Locus

(56) References Cited

OTHER PUBLICATIONS

NC_009440, Accession No. NC_009440, "Metallosphaera sedula DSM 5348, complete genome," [online]. Bethesda, MD [retrieved on YYYY-MM-DD]. Retrieved from the Internet: <URL:http://genomoe.jp/dbget-bin/www_bget?refseq+NC_009440>; 295pgs.
Nielsen et al., "Engineering alternative butanol production platforms in heterologous bacteria," *Metab Eng*, 2009; 11:262-73.
Nunn et al., "Metabolism of Pentose Sugars in the Hyperthermophilic Archaea *Sulfolobus solfataricus* and *Sulfolobus acidocaldarius*" *J Biol Chem*, 2010; 285:33701-33709.
Oelze and Fuller, "Temperature dependence of growth and membrane-bound activities of *Chloroflexus aurantiacus* energy metabolism," *J Bacteriol*, 1983; 155:90-96.
Olson et al., "Recent progress in consolidated bioprocessing" *Curr Opinion Biotech*, 2012; 23(3):396-405.
Ostendorp et al., "Extremely thermostable L(+)-lactate dehydrogenase from *Thermotoga maritima*: cloning, characterization, and crystallization of the recombinant enzyme in its tetrameric and octameric state," *Protein Sci*, 1996; 5:862-73.
Oudshoorn et al., "Assessment of options for selective 1-butanol recovery from aqueous solutions," *Ind Eng Chem Res*, 2009; 48:7325-7336.
Oxer et al., "High level heterologous expression in *E. coli* using the anaerobically-activated nirB promoter," *Nucleic Acids Res*, 1991; 19:2889-92.
Paster et al., *Industrial Biproducts: today and tomorrow, US Dept of Energy and Energetics Inc*., Columbia MD, Jul. 2003. 92 pages.
Peeples and Kelly, "Bioenergetic response of the thermoacidophilic archaeum *Metallosphaera sedula* to thermal and nutritional stress," *Appl Environ Microbiol*, 1995; 61:2314-2321.
Peeples and Kelly, "Bioenergetics of the metal/sulfur-oxidizing extreme thermoacidophile *Metallosphaera sedula*," *Fuel*, 1993; 72:1619-1624.
Peralta-Yahya et al., "Advanced biofuel production in microbes," *Biotechnol J*., Feb. 2010;5(2):147-162.
Persson et al., "Regulation of phosphate acquisition in *Saccharomyces cerevisiae*," *Curr Genet*, 2003; 43:225-44.
Pierik et al., "Carbon monoxide and cyanide as intrinsic ligands to iron in the active site of [NiFe]-hydrogenases. NiFe(CN)2CO, Biology's way to activate H2," *J Biol Chem*, 1999; 274:3331-7.
Porthun et al., "Expression of a functional NAD-reducing [NiFe] hydrogenase from the gram-positive *Rhodococcus opacus* in the gram-negative *Ralstonia eutropha*," *Arch Microbiol*, 2002; 177:159-66.
Przybyla et al., "Structure-function relationships among the nickel-containing hydrogenases," *FEMS Microbiol Rev*, 1992; 8:109-35.
Price et al., "Aflatoxin conducive and non-conducive growth conditions reveal new gene associations with aflatoxin production," *Fungal Genet Biol*, 2005;42:506-518.
Pryde et al., "The microbiology of butyrate formation in the human colon" *FEMS Microbiol. Lett*, 2002; 217:133-139.
Pysz et al., Significance of polysaccharides in the microbial physiology and ecology of hot deep-sea subsurface biotopes. American Geophysical Union Monograph Series 144 on the Subseafloor Biosphere at Mid-Ocean Ridges, W. Wilcock, C. Cary, E. DeLong, D. Kelley, and J. Baross, Eds., 2004; pp. 213-226.
Pysz et al., "Transcriptional analysis of dynamic heat shock response by the hyperthermophilic bacterium *Thermotoga maritima*," *Extremophile*, 2004; 8:209-17.
Pysz et al., "Transcriptional analysis of biofilm formation processes in the anaerobic hyperthermophilic bacterium *Thermotoga maritima*," *Appl Environ Microbiol*, 2004; 70:6098-6112.
Ragsdale, S. W. "Enzymology of the acetyl-CoA pathway of CO2 fixation," *Crit Rev Biochem Mol Biol*, 1991; 26:261-300.
Ramos-Vera et al., "Identification of Missing genes and Enzymes for Autotrophic Carbon Fixation in *Crenarchaeota*," *J. Bacteriol*, Mar. 2011;193(5):1201-1211.
Remonsellez, F., A. Orell, and C. A. Jerez. 2006. Copper tolerance of the thermoacidophilic archaeon *Sulfolobus metallicus*: possible role of polyphosphate metabolism. Microbiology 152:59-66.
Riddles et al., "Reassessment of Ellman's Reagent" in *Methods in Enzymology*, 1983; 91:49-60.
Roberts et al., "The reductive acetyl coenzyme A pathway: sequence and heterologous expression of active methyltetrahydrofolate:corrinoid/iron-sulfur protein methyltransferase," *Clostridium thermoaceticum, J Bacteriol*, 1994; 176:6127-30.
Rousset, M., V. Magro, N. Forget, B. Guigliarelli, J. P. Belaich, and E. C. Hatchikian. 1998. Heterologous expression of the *Desulfovibrio gigas* [NiFe] hydrogenase in *Desulfovibrio fructosovorans* MR400. *J Bacteriol* 180:4982-6.
Roy et al., "I-TASSER: a unified platform for automated protein structure and function prediction" *Nat Protoc*, 2010; 5:725-738.
Sambrook et al., *Molecular Cloning: A Laboratory Manual*, $2^{nd}$ edition, 1989; Spring Harbor Laboratory Press, Cold Spring Harbor, NY; face page, copyright page.
Santangelo et al., "Polarity in archaeal operon transcription in *Thermococcus kodakaraensis*," *J Bacteriol*, 2008; 190:2244-8.
Sapra et al., "Purification and characterization of a membrane-bound hydrogenase from the hyperthermophilic archaeon *Pyrococcus furiosus*," *J Bacteriol*, 2000; 182:3423-8.
Sapra et al., "A simple energy-conserving system: Proton reduction coupled to proton translocation," *Proc Natl Acad Sci USA*, Jun. 24, 2003;100(13):7545-7550.
Sato et al., "Thermostable ATP regeneration system using polyphosphate kinase from *Thermosynechococcus elongatus* BP-1 for D-amino acid dipeptide synthesis," *J Biosci Bioeng*, 2007; 103:179-84.
Schelert et al., "Regulation of mercury resistance in the crenarchaeote *Sulfolobus solfataricus*," *J Bacteriol*, 2006; 188:7141-7150.
Scherf et al., "Purification and properties of an iron-sulfur and FAD-containing 4-hydroxybutyryl-CoA dehydratase/vinylacetyl-CoA$\Delta^3$ - $\Delta^2$ -isomerase from *Clostridium aminobutyricum*" *Eur J. Biochem*, 1993; 215:421-9.
Schicho et al., "Bioenergetics of sulfur reduction in the hyperthermophilic archaeon, Pyrococcus furiosus," *J. Bacteriol*., 1993; 175:1823-1830.
Schmelz and Naismith, *Current Opinion in Structural Biology*, 2009;19:666-671.
Schut et al., "The iron-hydrogenase of *Thermotoga maritima* is a ferredoxin and NADH bifurcating enzyme: insights into anaerobic biofuel production," *J. Bacteriol*., Jul. 2009;191(13):4451-4457.
Schut et al., "Whole-genome DNA microarray analysis of a hyperthermophile and an archaeon: *Pyrococcus furiosus* grown on carbohydrates or peptides," *J Bacteriol*, 2003; 185:3935-47.
Schut et al., "Insights into the metabolism of elemental sulfur by the hyperthermophilic archaeon *Pyrococcus furiosus*: characterization of a coenzyme A-dependent NAD(P)H sulfur oxidoreductase," *J Bacteriol*, 2007; 189:4431-41.
She et al., "The complete genome of the crenarchaeon *Sulfolobus solfataricus* P2," *Proc Natl Acad Sci USA*, Jul. 3, 2001; 98(14):7835-7840.
Shen et al., "Driving Forces Enable High-Titer Anaerobic 1-Butanol Synthesis in *Escherichia coli*" *Appl Environ Microbiol*, 2011; 77(9):2905-2915.
Shivvers and Brock, "Oxidation of Elemental Sulfur by *Sulfolobus acidocaldarius*" *J Bacteriol*, 1973; 114:706-710.
Shockley et al., "Genome-wide transcriptional variation within and between steady states for continuous growth of the hyperthermophile *Thermotoga maritima*," *Appl Environ Microbiol*, 2005; 71:5572-76.
Sirevag et al., "Carbon dioxide—fixation in photosynthetic green sulfur bacteria," *Science*, 1970; 169:186-8.
Skerra and Schmidt "Applications of a peptide ligand for streptavidin: the Strep-tag" *Biomol Eng*., 1999; 16:79-86.
Sleep, "$H_2$ -rich fluids from serpentinization: Geochemical and biotic implications" *PNAS USA*, 2004; 101:12818-12823.
Sommerville et al., "Feedstocks for Lignocellulosic Biofuels" *Science*, 2010; 329(5993):790-2.
Spear et al., "Hydrogen and bioenergetics in the Yellowstone geothermal ecosystem," *PNAS USA*, Feb. 15, 2005;102(7):2555-2560.

(56) References Cited

OTHER PUBLICATIONS

Starai et al., "Sir2-Dependent Activation of Acetyl-CoA Synthetase by Deacetylation of Active Lysine" *Science*, 2002; 298:2390-2392.
Steen et al., "Metabolic engineering of *Saccharomyces cerevisiae* for the production of n-butano," *Microb Cell Fact*, 2008; 7:36.
Steen et al., "Microbial production of fatty-acid-derived fuels and chemicals from plant biomass," *Nature*, 2010;463(7280):559-562.
Strauss et al., "13C-NMR study of autotrophic CO2 fixation pathways in the sulfur-reducing Archaebacterium *Thermoproteus neutrophilus* and in the phototrophic Eubacterium *Chloroflexus aurantiacus*," *Eur J Biochem*, 1992; 205:853-66.
Strauss et al., "Enzymes of a novel autotrophic CO2 fixation pathway in the phototrophic bacterium *Chloroflexus aurantiacus*, the 3-hydroxypropionate cycle," *Eur J Biochem*, 1993; 215:633-43.
Studier, "Protein Production by Auto-Induction in High-Density Shaking Cultures" *Protein Expression and Purification*, 2005; 41:207-234.
Sugar et al., "Comparison of small- and large-scale expression of selected *Pyrococcus furiosus* genes as an aid to high-throughput protein production," *J Struct Funct Genomics*, 2005; 6:149-58.
Sun et al., "Heterologous Expression and Maturation of an NADP-Dependent [NiFe]-Hydrogenase: A Key Enzyme in Biofuel Production," *PLoS One*, May 2010;5(5): e10526.
Tachdjian et al., "Metabolic adjustments and genome plasticity are implicated in *Sulfolobus solfataricus* response to pH and thermal stress," *J Bacteriol*, 2006; 188:4553-4559.
Tachdjian, S., and R.M. Kelly. Functional Genomics of Stress Response. In Archaea: New Models for Prokaryotic Biology, P. Blum, Editor., 2007; 15 pages.
Tatusova et al, "BLAST 2 Sequences, a new tool for comparing protein and nucleotide sequences," *FEMS Microbiol Lett*, 1999;174:247-250.
Taylor et al., "Thermophilic ethanologenesis: future prospects for second-generation bioethanol production," *Trends Biotechnol*, 2009; 27:398-405.
Teufel et al., "3-hydroxypropionyl-coenzyme A dehydratase and acryloyl-coenzyme A reductase, enzymes of the autotrophic 3-hydroxypropionate/4-hydroxybutyrate cycle in the Sulfolobales," *J Bacteriol*, 2009;191:4572-4581.
Thauer et al., "Energy conservation in chemotrophic anaerobic bacteria," *Bacteriol Rev*, 1977; 41:100-80.
Tucker et al., "A sterilisation time-temperature integrator based on amylase from the hyperthermophilic organism *Pyrococcus furiosus*," *Innov. Food Sci. Emerg. Tech.*, 2007; 8:63-72.
Valafarn et al., "Backbone solution structures of proteins using residual dipolar couplings: application to a novel structural genomics target," *J Struct Funct Genomics*, 2004; 5:241-54.
Valentin et al., "Metabolic pathway for biosynthesis of poly(3-hydroxybutyrate-co-4-hydroxybutyrate) from 4-hydroxybutyrate by *Alcaligenes eutrophus*" *Eur J. Biochem*, 1995; 227:43-60.
Van de Werken et al., "Hydrogenomics of the extremely thermophilic bacterium *Caldicellulosiruptor saccharolyticus*," *Appl. Environ. Microbiol.*, 2008; 74:6720-6729.
Van der Meer et al., "Stable carbon isotope fractionations of the hyperthermophilic crenarchaeon *Metallosphaera sedula*," *FEMS Microbiol Lett*, 2001; 196:67-70.
VanFossen et al., "Anaerobic polysaccharide formation and degradation in hyperthermophiles," *Ann. NY Acad. Sci.*, 2008; 1125:322-337.
Verhagen, et al., "Heterologous expression and properties of the gamma-subunit of the Fe-only hydrogenase from *Thermotoga maritima*," *Biochim Biophys Acta*, 2001; 1505:209-19.
Vignais and Billoud, "Occurrence, classification, and biological function of hydrogenases: an overview," *Chem Rev*, 2007; 107:4206-72.
Vignais et al., "Classification and phylogeny of hydrogenases," *FEMS Microbiol Rev*, 2001; 25:455-501.
Volbeda et al., "Crystal structure of the nickel-iron hydrogenase from *Desulfovibrio gigas*," *Nature*, 1995; 373:580-7.
Volbeda et al., "Novel metal sites in protein structures," *Curr Opin Struct Biol*, 1996; 6:804-12.
Wachtershauser, "Evolution of the first metabolic cycles," *Proc Natl Acad Sci U S A*, 1990; 87:200-4.
Wackett, "Engineering microbes to produce biofuels" *Curr Opinin Biotechnol*, 2011; 22(3):388-393.
Wang et al., "PF0610, a novel winged helix-turn-helix variant possessing a rubredoxin-like Zn ribbon motif from the hyperthermophilic archaeon, *Pyrococcus furiosus*," *Biochemistry*, 2007; 46:752-61.
Wang et al., "Comprehensive Study of the Hydration and Dehydration Reactions of Carbon Dioxide in Aqueous Solution" *J Phys Chem A*, 2010; 114:1734-1740. Published Online Dec. 29, 2009.
Wang et al., "Protein production and crystallization at SECSG—an overview," J Struct Funct Genomics, 2005; 6:233-43.
Weinberg et al., "Cold shock of a hyperthermophilic archaeon: *Pyrococcus furiosus* exhibits multiple responses to a suboptimal growth temperature with a key role for membrane-bound glycoproteins," *J Bacteriol*, 2005;187:336-348.
Werpy & Peterson, Top value added chemicals from biomass: vol. 1—results of Screening for Potentioal Candidates from Sugars and Synthesis Gas *Dept of Energy*, 2004; 102004-1992, 76 pages.
Wiegel et al., eds. 2008. *Incredible Anaerobes: From Physiology to Genomics to Fuels*, vol. 1125, 373 pp, Ann. N.Y. Acad. Sci., New York. Cover page, title page, and table of contents.
Wilhelm et al., "Low-Pressure Solubility of Gases in Liquid Water" *Chem Rev.*, 1977; 77(2):219-262.
Woodward et al., "In vitro hydrogen production by glucose dehydrogenase and hydrogenase," *Nat Biotechnol*, 1996; 14:872-4.
Xu et al., "Perspectives and new directions for the production of bioethanol using consolidated bioprocessing of lignocellulose," *Curr Opin Biotechnol*, 2009; 20:364-71.
Ye et al., "Spontaneous high-yield production of hydrogen from cellulosic materials and water catalyzed by enzyme cocktails," *ChemSusChem*, 2009; 2:149-152.
Ying et al., "Molecular characterization of the recombinant iron-containing alcohol dehydrogenase from the hyperthermophilic Archaeon, Thermococcus strain ES1," *Extremophiles*, 2009; 13:299-311.
Yoon et al., "Parallel evolution of transcriptome architecture during genome reorganization" *Genome Res*, 2011; 21(11):1892-1904.
Young et al., "Microwave activation of enzymatic catalysis," *JACS*, 2008; 130:10048-10049.
Zarzycki et al., "Identifying the missing steps of the autotrophic 3-hydroxypropionate CO2 fixation cycle in *Chloroflexus aurantiacus*," *Proc Natl Acad Sci USA*, 2009; 106:21317-21322.
Zhang et al., "High-yield hydrogen production from starch and water by a synthetic enzymatic pathway," *PLoS ONE*, 2007; 2:e456.
Ziegelmann-Fjeld et al., "A *Thermoanaerobacter ethanolicus* secondary alcohol dehydrogenase mutant derivative highly active and stereoselective on phenylacetone and benzylacetone," *Protein Eng Des Sel*, 2007; 20:47-55.

\* cited by examiner

Fig. 3

| Msed ORF | Hetero | Auto | Mixo | ACL | ACR | HTR | JGI Integrated Microbial Genomes Annotation | LSM ACL | ACL-HTR fold change | $-\log_{10}$(p-value) |
|---|---|---|---|---|---|---|---|---|---|---|
| Msed0267 | | | | | | | Acetyl-CoA synthetase | -0.5 | 0.5 | 2.3 |
| Msed0394 | | | | | | | AMP-dependent synthetase and ligase | 2.2 | 1.8 | 2.2 |
| Msed0401 | | | | | | | Medium-chain-fatty-acid--CoA ligase | 1 | 0.5 | 2.3 |
| Msed0406 | | | | | | | Acetyl-CoA synthetase | 1.8 | 1 | 0.02 |
| Msed1015 | | | | | | | Hypothetical long-chain-fatty-acid--CoA ligase | -0.2 | 1.1 | 0.2 |
| Msed1224 | | | | | | | Medium-chain-fatty-acid--CoA ligase | -1 | 0.5 | 7.8 |
| Msed1291 | | | | | | | Hypothetical acetyl-CoA synthetase | -0.6 | 0.7 | 0.7 |
| Msed1353 | | | | | | | Acetyl-coenzyme A synthetase | 3.2 | 6.2 | 8.6 |
| Msed1422 | | | | | | | Medium-chain-fatty-acid--CoA ligase | 2.1 | 13 | 15 |

Fig. 8

| SEQ ID NO | Name | | 481 a d t y g q t E T g | 491 g . m i . t p f p . | |
|---|---|---|---|---|---|
| SEQ ID NO:400 | Consensus | | | | |
| | Conservation | | | | |
| SEQ ID NO:401 | STM4275 | 410 | V D T W W Q T E T G | G F M I . T P L P . | 427 |
| SEQ ID NO:19 | Msed_0394 | 329 | C H V Y G L T E T Y | G P H S I C E W R . | 347 |
| SEQ ID NO:20 | Msed_0401 | 317 | A V G Y G M S E T A | P V L T . V A Y Y T | 335 |
| SEQ ID NO:21 | Msed_0406 | 342 | R D F Y G Q T E T T | A . M V . G N F P . | 358 |
| SEQ ID NO:22 | Msed_1291 | 330 | T D I Y G Q S E T G | Y V V G . T P F F S | 347 |
| SEQ ID NO:23 | Msed_1353 | 420 | G S T W W M T E T G | G I M I . S H M P . | 437 |
| SEQ ID NO:24 | Msed_1422 | 273 | I S V M G T T D G H | M . A V . E V . . . | 287 |

Fig. 28

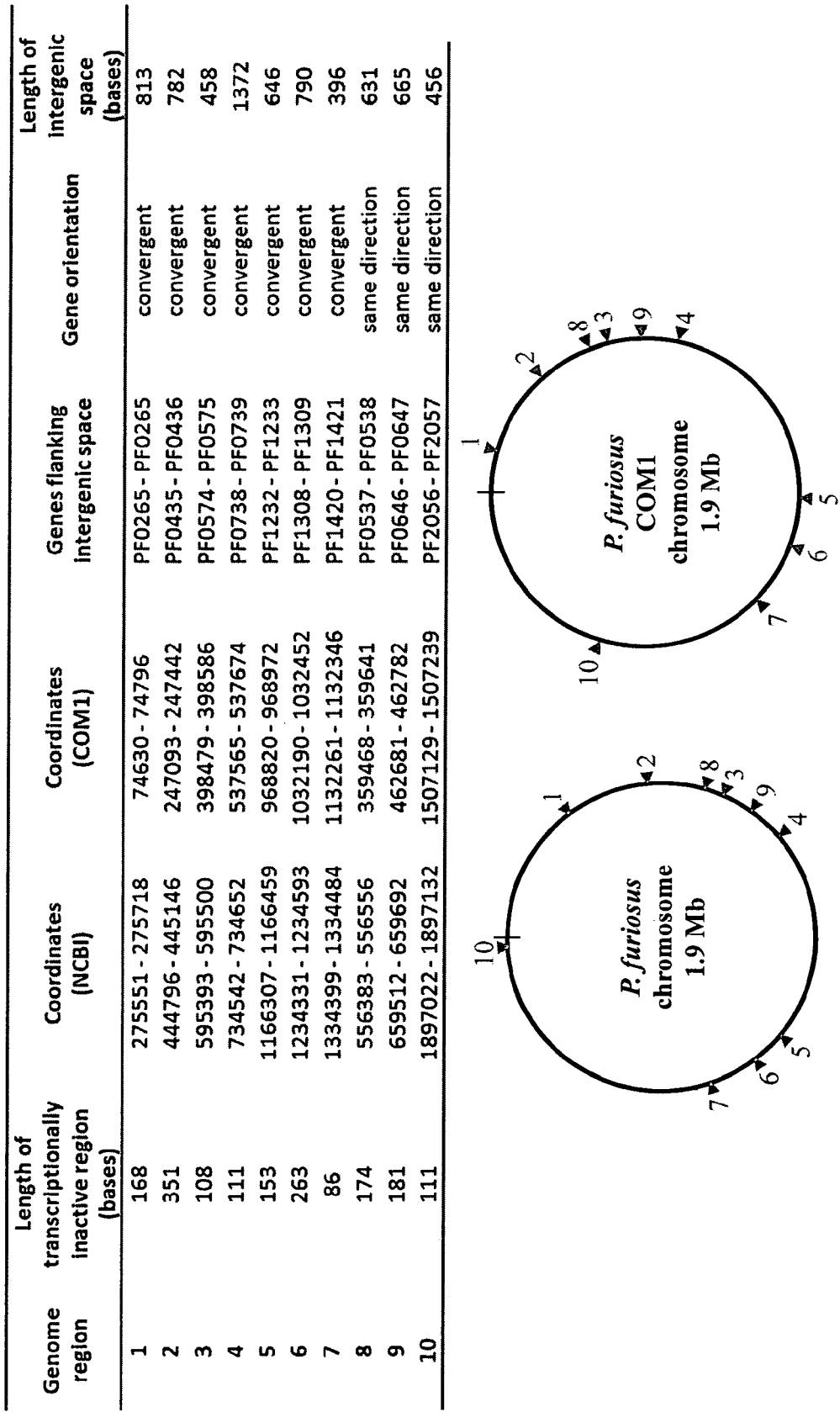

| Genome region | Length of transcriptionally inactive region (bases) | Coordinates (NCBI) | Coordinates (COM1) | Genes flanking intergenic space | Gene orientation | Length of intergenic space (bases) |
|---|---|---|---|---|---|---|
| 1 | 168 | 275551 - 275718 | 74630 - 74796 | PF0265 - PF0265 | convergent | 813 |
| 2 | 351 | 444796 - 445146 | 247093 - 247442 | PF0435 - PF0436 | convergent | 782 |
| 3 | 108 | 595393 - 595500 | 398479 - 398586 | PF0574 - PF0575 | convergent | 458 |
| 4 | 111 | 734542 - 734652 | 537565 - 537674 | PF0738 - PF0739 | convergent | 1372 |
| 5 | 153 | 1166307 - 1166459 | 968820 - 968972 | PF1232 - PF1233 | convergent | 646 |
| 6 | 263 | 1234331 - 1234593 | 1032190 - 1032452 | PF1308 - PF1309 | convergent | 790 |
| 7 | 86 | 1334399 - 1334484 | 1132261 - 1132346 | PF1420 - PF1421 | convergent | 396 |
| 8 | 174 | 556383 - 556556 | 359468 - 359641 | PF0537 - PF0538 | same direction | 631 |
| 9 | 181 | 659512 - 659692 | 462681 - 462782 | PF0646 - PF0647 | same direction | 665 |
| 10 | 111 | 1897022 - 1897132 | 1507129 - 1507239 | PF2056 - PF2057 | same direction | 456 |

Fig. 29
Genome region 2 SOE-PCR product used in constructing pGL002
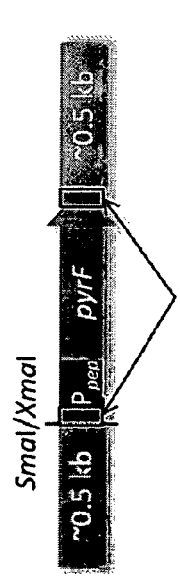
Genome region 3 SOE-PCR product used in constructing pGL007
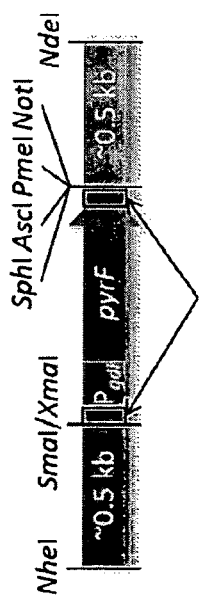

Fig. 45

| Msed ORF | ACL HTR | Gene Annotation (Integrated Microbial Genomes) | ACL vs. HTR fold change | !log₁₀(p-value) |
|---|---|---|---|---|
| Msed0306 | | pyruvate/ketoisovalerate oxidoreductase, gamma subunit | 2 ↓ | 3 |
| Msed0307 | | pyruvate ferredoxin/flavodoxin oxidoreductase, delta subunit | - | - |
| Msed0308 | | pyruvate flavodoxin/ferredoxin oxidoreductase domain protein | 3 ↓ | 7 |
| Msed0309 | | thiamine pyrophosphate enzyme domain protein TPP-binding | 7 ↓ | 8 |
| Msed0507 | | pyruvate/ketoisovalerate oxidoreductase, gamma subunit | - | - |
| Msed0508 | | pyruvate ferredoxin/flavodoxin oxidoreductase, delta subunit | 85 ↓ | - |
| Msed0509 | | pyruvate flavodoxin/ferredoxin oxidoreductase domain protein | - | - |
| Msed0510 | | thiamine pyrophosphate enzyme domain protein TPP-binding | - | - |
| Msed0524 | | pyruvate ferredoxin/flavodoxin oxidoreductase, beta subunit | 5 ↓ | 11 |
| Msed0525 | | pyruvate flavodoxin/ferredoxin oxidoreductase domain protein | 5 ↓ | 7 |
| Msed1199 | | thiamine pyrophosphate enzyme domain protein TPP-binding | - | - |
| Msed1200 | | pyruvate flavodoxin/ferredoxin oxidoreductase domain protein | - | - |
| Msed1201 | | pyruvate ferredoxin/flavodoxin oxidoreductase, delta subunit | 3 " | 6 |
| Msed1596 | | pyruvate ferredoxin/flavodoxin oxidoreductase | 23 ↓ | 14 |
| Msed1597 | | thiamine pyrophosphate enzyme domain protein TPP-binding | 10 ↓ | 12 |

Fig. 46-1

Msed_0147 (E1 alpha) (SEQ ID NO:1)
MPPFSRVLVANRGEIAVRVMKAIKEMGMTAIAVYSEADKYAVHVKYADEAYYIGPSPALESYLNIPHIID
AAEKAHADAVHPGYGFLSENADFVEAVEKAGMTYIGPSAEVMRKIKDKLDGKRIAQLSGVPIAPGSDGPV
ESIDEALKLAEKIGYPIMVKAASGGGGVGITKIDTPDQLIDAWERNKRLATQAFGRSDLYIEKAAVNPRH
IEFQLIGDKYGNYVVAWERECTIQRRNQKLIEEAPSPAITMEERSRMFEPIYKYGKLINYFTLGTFETVF
SDATREFYFLELNKRLQVEHPVTELIFRIDLVKLQIRLAAGEHLPFTQEELNKRARGAAIEFRINAEDPI
NNFSGSSGFITYYREPTGPGVRMDSGVTEGSWVPPFYDSLVSKLIVYGEDRQYAIQTAMRALDDYKIGGV
KTTIPLYKLIMRDPDFQEGRFSTAYISQKIDSMVKKLKAEEEMMASVAAVLQSRGLLRKKASAPQEQAKP
GSGWKSYGIMMQSTPRVMWG Msed_0148 (E1 beta) (SEQ ID NO:2)
MKLYRVHADTGDTFIVAHDQKENKDRLKTENNEFEIEYVGQGTREGEIILKINGEMHRVFIDNGWIILDN
ARIFRAERVTELPTQEGQTLDEMIKGKEGEVLSPLQGRVVQVRVKEGDAVNKGQPLLSIEAMKSETIVSA
PISGLVEKVLVKAGQGVKKGDILVVIK Msed_1375 (E1 gamma) (SEQ ID NO:3)
MTATFEKPDMSKLVEELRALKAKAYMGGGEERVQAQHAKGKLTARERLNLLFDEGTFNEVMTFATTKATE
FGLDKSKVYGDGVVTGWGQVEGRTVFAFAQDFTSIGGTLGETHASKIAKVYELALKVGAPVVGINDSGGA
RIQEGAVALEGYGTVFKANVMASGVVPQITIMAGPAAGGAVYSPALTDFIIMIKGDAYYMFVTGPEITKV
VLGEDVSFQDLGGAVIHATKSGVVHFIAENEQDSINITKRLLSYLPSNNMEEPPFMDTGDPADREMKDVE
SVVPTDTVKPFDMREVIYRTVDNGEFMEVQKHWAQNMVVGFGRVAGNVVGIVANNSAHLGAAIDIDASDK
AARFIRFCDAFNIPLISLVDTPGYMPGTDQEYKGIIRHGAKMLYAFAEATVPKVTVVVRRSYGGAHIAMS
IKSLGADLIYAWPSAEIAVTGPEGAVRILYRREIQNSKSPDDLIKERIAEYKKLFANPYWAAEKGLIDDV
IEPKDTRKVIASALKMLKNKREFRYPKKHGNIPL Msed_0709 (E2) (SEQ ID NO:4)
MRRTLKAAILGATGLVGIEYVRMLADHPYIKPTYLAGKGSVGKPYGEIVRWQTVGNVPKEVANQEVKPTD
PKLMDDVDIIFSPLPQGAAGPVEEQFAKLGFNVISNSPDHRFDMDVPMIIPEVNPHTVTLIDEQRKRRDW
KGFIVTTPLCTAQGAAIPLTPIYQNFKMSGVMITTMQSLSGAGYPGIASLDIVDNALPLGDGYDAKTVKE
ITRILSEVKRNVQEPGVNEITLDATTHRIATIHGHYEVAYVTFKEDTDVRKVMESMESFKGEPQDLKLPT
APEKPIIVTTQDARPQVFFDRWAGNPPGMSVVVGRLKQVNPRTIRFVSLIHNTVRGAAGGGVLTAELLVE
KGYIDKR Msed_1993 (E3) (SEQ ID NO:5)
MTEKVSVVGAGVIGVGWATLFASKGYSVSLYTEKKETLDKGIEKLRNYVQVMKNNSQITEDVNTVISRVS
PTTNLDEAVRGANFVIEAVIEDYDAKKKIFGYLDSVLDKEVILASSTSGLLITEVQKAMSKHPERAVIAH
PWNPPHLLPLVEIVPGEKTSMEVVERTKSLMEKLDRIVVVLKKEIPGFIGNRLAFALFREAVYLVDEGVA
TVEDIDKVMTAAIGLRWAFMGPFLTYHLGGGEGGLEYFFNRGFGYGANEWMHTLAKYDKFPYTGVTKAIQ
QMKEYSFIKGKTFQEISKWRDEKLLKVYKLVWEK

Fig. 46-2

Msed_1456 (E4) (SEQ ID NO:6)
MFMRYIMVEEQTLKTGSQELEEKADYNMRYYAHLMKLSKEKPAEFWGSLAQDLLDWYEPWKETMRQEDPM
TRWFIGGKINASYNAVDRHLNGPRKFKAAVIWESELGERKIVTYQDMFYEVNRWANALRSLGVGKGDRVT
IYMPLTPEGIAAMLASARIGAIHSVIFAGFGSQAIADRVEDAKAKVVITADAYPRRGKVVELKKTVDEAL
NSLGERSPVQHVLVYRRMKTDVNMKEGRDVFFDEVGKYRYVEPERMDSNDPLFILYTSGTTGKPKGIMHS
TGGYLTGTAVMLLWSYGLSQENDVLFNTSDIGWIVGHSYITYSPLIMGRTVVIYESAPDYPYPDKWAEII
ERYRATTFGTSATALRYFMKYGDEYVKNHDLSSIRIIVTNGEVLNYSPWKWGLEVLGGGKVFMSHQWWQT
ETGAPNLGYLPGIIYMPMKSGPASGFPLPGNFVEVLDENGNPSAPRVRGYLVMRPPFPPNMMMGMWNDNG
ERLKKTYFSKFGSLYYPGDFAMVDEDGYIWVLGRADETLKIAAHRIGAGEVESAITSHPSVAEAAVIGVP
DSVKGEEVHAFVVLKQGYAPSSELAKDIQSHVRKVMGPIVSPQIHFVDKLPKTRSGKVMRRVIKAVMMGS
SAGDLTTIEDEASMDEIKKAVEELKKELKTS Msed_2001 (E5) (SEQ ID NO:7)
MEFETIETKKEGNLFWITLNRPDKLNALNAKLLEELDRAVSQAESDPEIRVIIITGKGKAFCAGADITQF
NQLTPAEAWKFSKKGREIMDKIEALSKPTIAMINGYALGGGLELALACDIRIAAEEAQLGLPEINLGIYP
GYGGTQRLTRVIGKGRALEMMMTGDRIPGKDAEKYGLVNRVVPLANLEQETRKLAEKIAKKSPISLALIK
EVVNRGLDSPLLSGLALESVGWGVVFSTEDKKEGVSAFLEKREPTFKGK Msed_1426 (E6) (SEQ ID NO:8)
MKAVVVKGHKQGYEVREVQDPKPASGEVIIKVRRAALCYRDLLQLQGFYPRMKYPVVLGHEVVGEILEVG
EGVTGFSPGDRVISLLYAPDGTCHYCRQGEEAYCHSRLGYSEELDGFFSEMAKVKVTSLVKVPTRASDEG
AVMVPCVTGMVYRGLRRRANLREGETVLVTGASGGVGIHALQVAKAMGARVVGVTTSEEKASIVGKYADRV
IVGSKFSEEAKKEDINVVIDTVGTPTFDESLKSLWMGGRIVQIGNVDPTQSYQLRLGYTILKDIAIIGHA
SATRRDAEGALKLTAEGKIRPVVAGTVHLEEIDKGYEMLKDKHKVGKVLLTT Msed_0639 (E7) (SEQ ID NO:9)
METLDIDHVGVAVENLEEAIKLYTEKMGMKLVHREDLPDRGIKVAFLTGNEGTTAVELMEPMNHEDPNNT
VAKFLKTRGQGMHHLAVKVKDINSSLRDLEGKGLTLIDKNGRKGARGHLVAFVHPKSVMGLLLELVQETH Msed_0638 (E8 alpha) (SEQ ID NO:10)
MVTPERVKEWESKYLQPWISKRKERKNKFTTPSGIEIKTLYTPLDLKGDYEEKIGFPGEYPYTRGIYPNM
YRGRIWTIRQYAGFGSAEDTNARFRKLLEAGQTGLSTAFDLPTQLGLDPDNELAYTEVGVVGVSMFHWKE
MDIVTNQIPLNKVSTSMTINATAMELLSMYVATAESRGVSPTEIDGTVQNDILKEYIARKNYIYPPEPSM
RYAIDIIEYSYKNIPKWHPISISGYHIREAGADAVLEVAFTLADGIEYVRRTAERGIPVDDFAPTLSFFF
AGYTNLFEEVAKFRAARRMWAKIMRDMFNAKKADSMTLKFHTQTGGAELTAQQPEINIIRTTIQALAAAL
GGTQSLHVNSYDEAVALPSEKAAKIAIRVQQIVAYESGSTETVDPLAGSYYVEWLTDEIEERAWKIIERV
EGMGGMMKAVERGFPQAEIAESAYRLQKKIEEGEMIRVGVNMSYEPDWIGTTEVFRVNPEIRERVLTRLK
KYRSERDQMKVRDSLNALRKAAENPSVNLFPYVLDAIKKGCTVGEISSTLREIWGEYKEPIIF Msed_2055 (E8 beta) (SEQ ID NO:11)
MDKRIKVVVAKLGLDGHDRGAKVIARALKDAGMEVVYTGLRQTPEQIVRTAIQEDADVIGISILSGAHLE
LMPKIVEALKKAGLDDVGLVLGGVIPPEDIPKLKAMGVDDVFLPGTSLKEIAQRVSKLASTKRGIKVEG Msed_1424 (E9) (SEQ ID NO:12)
MKAAVLHTYKEPLSIEDVNISQPKAGEVKIKVKATGLCHSDVNVFEGKTPVPPPVAGHEISGIVEEVGP
GVTRVKPGDRVISAFIHPCGKCGNCVAGKENLCETFSQVRLKGVMPDGTSRLSKDGKEIRTFLGGGFAEY
AIVGENALTRVPEDMDLEKVAVLGCAGLTGYGAISSSKIEPGDTVAVIGVGGVGLSTIQLLRASGAGRII
AVGTKKWKLDRAMELGATDVVNSKEIDPVKAIKEITGGGPQVVIEAGGNEDTIHMALDSVRIGGKVVLVG
LPPATAMIPIRVASIVRGGIEVVGNYGGRPRVDMPKLLELVRQGRYDPSRLVTGRFRLEEINEAVKMLEE
GEAIRSLIIP

Fig. 46-3

Msed_0406 (E10) (SEQ ID NO:14)
MVTVQDFFRKFIEFQNSPNEKSLQEIVKLVGQLDLRRFNWVRDVFEDIHVKERGSKTALIWRDINTGEEA
KLSYHELSLMSNRVLSTLRKHGLKKGDVVYLMTKVHPMHWAVFLAVIKGGFVMVPSATNLTVAEMKYRFS
DLKPSAIISDSLRASVMEEALGSLKVEKFLIDGKRETWNSLEDESSNAEPEDTRGEDVIINYFTSGTTGM
PKRVIHTAVSYPVGSITTASIVGVRESDLHLNLSATGWAKFAWSSFFSPLLVGATVVGINYEGKLDTRRY
LGEVENLGVTSFCAPPTAWRQFITLDLDQFRFERLRSVVSAGEPLNPEVIKIWKDKFNLTIRDFYGQTET
TAMVGNFPFLKVKPGSMGKPHPLYDIRLLDDEGKEITKPYEVGHITVKLNPRPIGLFLGYSDEKKNMESF
REGYYYTGDKAYFDEEGYFYFVGRGDDVIKTSDYRVGPFEVESALLEHPAVAEAAVVGVPDTVRWQLVKA
YIVLKKGYMPSKELAEEIREKMKTLLSPYKVPRIIEFVDELPKTISGKIRRVELRKREEEKRKKGEVGQN
EYVF Msed_1353 (E10) (SEQ ID NO:18)
MSQPENESGLPFQEKVVPELLKHRLVTPEEYLRIHKKTVENYQEYWESVAKELDWFKPWEKALDDSHPPF
YKWFVGGELNASYLAVDRHANSWRRNKVAIIWEGEPWENGPKEVRKLTYLDLYREVNRAAYLLKEVYGLK
KGDTIGIYLPMIPELPIFMLAAARLGVAFTVVFSGFSAQAVADRMNDADTKLLITADGGWRRGKVIPLKE
IVDKALETATTVKNVLVVRRTGTEISMKPGRDAYLHDVMSKVPIKAYVEPERVKSEDPLYILYTSGTTGK
PKGIIHDTGGYMTLLHNTMKLVFDIRDTDVFWCTADIGWVTGHSYIVFGPLQEGATEVMYEGALDFPEPD
RWVSIIERHQVSILYTSPTAIRTFMKQGEQWIKKHDVSSVRLMHSVGEPINPEAWRWFHKLVGRGQVPFG
STWGMTETGGIMISHMPGGYLVPMKPGTNGPPLLGIETNVFDEEGKPMPEEQKGYLVITKPWPGMPLTIN
KDPERYVKVYWNKFPNVFYAGDYAIKDRDGYFWILGRADEVMKIAGHRIGTYELESALVQHPAIAEAAVV
GVPDPVRGEVAEAFVILRSGVEPSAKLREEIVKFVRENFGPIAVFREIHFVSKLPKTRSGKIMRRVIKAV
ATNSPVGDVTTLEDEASVEEVKKAFQELKEQVGK Msed_0394 (E10) (SEQ ID NO:13)
MGGFKIPNYEGVDPTGSWYSVLTPLLFLERAGKYFKDKTAVVYRDSRYTYSTFYDNVMVQASALMRRGFS
REDKLSFISRNRPEFLESFFGVPYAGGVLVPINFRLSPKEMAYIINHSDSKFVVVDEPYLNSLLEVKDQI
KAEIILLEDPDNPSASETARKEVRMTYRELVKGGSRDPLPIPAKEEYSMITLYYTSGTTGLPKGVMHHHR
GAFLNAMAEVLEHQMDLNSVYLWTLPMFHAASWGFSWATVAVGATNVCLDKVDYPLIYRLVEKERVTHMC
AAPTVYVNLADYMKRNNLKFSNRVHMLVGAAPAPATLKAMQEIGGYMCHVYGLTETYGPHSICEWRREW
DSLPLEEQAKLKARQGIPYVSFEMDVFDANGKPVPWDGKTIGEVVMRGHNVALGYYKNPEKTAESFRDGW
FHSGDAAVVHPDGYIEIVDRFKDLINTGGEKVSSILVEKTLMEIPGVKAVAVYGTPDEKWGEVVTARIEL
QEGVKLTEEEVIKFCKERLAHFECPKIVEFGPIPMTATGKMQKYVLRNEAKAKANKEKS Msed_1321 (E11) (SEQ ID NO:15)
MVVRTGEQYLQSISNRSKVEIYVMGREVKDVTKHPFLKPSVMSFKATFDAAWEEDTKELGRAWSPYLEEE
INRFNHIHRSPDDLAAKVKLLRKLSHKTGACFQRCVGWDSLNTLHIVTTMMAKKGKTEVRDRFVEYLKYV
QKNDLALAGAMTDAKGIRNLKPSQQPNKNAYLRITEVTKDGIYVSGAKANITGVAATEEMVVLPTRAMGP
EDKDYAVAFAIPTDTEGVKIVVGRQLNDARRMEEGEIDGLPYFYNHEGLVIFDNVFVPMNRVFLAGEWEY
TGTLVEIFSAYHRQGYGGCKAGLGDVIIGASADLAKQIGVDRASHVQDKLTEMIFLTETMYSAGIAASLN
AVKMCDNCWWVNPMHANVTKHLVARFPSQIAQLSIDLAGGIVGTAPSEWDLKNPKLKEYISRYLQGAEDF
TAEDRLRMVRLVENVSMGVAFQIESVHGAGSPAAQRIMFSRLYDLNFAQEVAKKLAGRKSEVKFTSKAEP
WRESQSEAEAKEAGLKS

Fig. 46-4

Msed_0399 (E12) (SEQ ID NO:16)
MKVTVIGSGVMGHGIAELAAIAGNEVWMNDISTEILQQAMERIKWSLSKLRESGSLKEGVEQVLARIHPE
TDQAQALKGSDFVIEAVKEDLELKRTIFRNAEAHASPSAVLATNTSSLPISEIASVLKSPQRVVGMHFFN
PPVLMPLVEIVRGKDTSDEVVKTTAEMAKSMNKETIVVKDVPGFFVNRVLLRIMEAGCYLVEKGIASIQE
VDSSAIEELGFPMGVFLLADYTGLDIGYSVWKAVTARGFKAFPCSSTEKLVSQGKLGVKSGSGYYQYPSP
GKFVRPTLPSTSKKLGRYLISPAVNEVSYLLREGIVGKDDAEKGCVLGLGLPKGILSYADEIGIDVVVNT
LEEMRQTSGMDHYSPDPLLLSMVKEGKLGRKSGQGFHTYAHEEAKYSTIVVRVEPPLAWIVLNRPTRYNA
INGDMIREINQALDSLEEREDVRVIAITGQGRVFSAGADVTEFGSLTPVKAMIASRKFHEVFMKIQFLTK
PVIAVINGLALGGGMELALSADFRVASKTAEMGQPEINLGLIPGGGGTQRLSRLSGRKGLELVLTGRRVK
AEEAYRLGIVEFLAEPEELESEVRKLANAIAEKSPLAVASAKLAYKLGEETHIWTGTSLEASLFGLLFST
KDFEEGVRAFLEKRKPNFRGE Msed_0656 (E13) (SEQ ID NO:17)
MPDVYIVSAVRTPIGRFGGSLKSVKPQMLGAIAIKEALRRANTDPSRVELTIMGNVLRSGHGQDLARQAA
LLAGIPWEVDGYCVDMVCSSGMMGVTNAAQMIKSGDADVVVAGGMESMSQSMLAVNSEVRWGVKFLSGKS
LNFIDTMLVDGLTDPFNLKLMGQEADMVARERDISRRELDEVAFESHRRAHQAWEKGLFKSEVIPVNLDE
GKLERDEGIRPDTTMEKLSSLKPAFTENGYHTAGNSSQISDGAVAMVLMSEKAVKEFGVDPVAKILGYSW
VGIESWRFTEAPLYSVRKLLTRLNMNITQFDYFENNEAFAVNNVLFHRYLGVPYDQLNVFGGAIALGHPI
GASGARIMVTLLNVLSKMNATRGIASICHGVGGSTAIALELLRPL

```
                                              501                        511
Conservation                                  *.*.*.**.*.*....*      .*..*.*...
640506050.Msed_0147                       494 WK S Y G T M M Q S    T P R V M W G
650848362.Ahos_2119                       498 W K T Y G L V S Q A   S S R V M W
650472093.SiRe_0254                       495 W K T Y G I I F Q S   S P R V L W
643841501.YN1551_2862                     495 W K T Y G I I F Q S   S P R V L W
638192839.ST0593                          498 W K T Y G L L Q Q S   S Y R V M W
2508723726.Met...iDRAFT_00020780          496 W K N Y G I V L Q S   S P R V M W G
646527065.LD85_0250                       495 W K T Y G I I F Q S   S P R Y L W
2524413480.SacN8_01265                    495 W K F Y G I M S Q S   S Y R V L W
643828153.M1425_0254                      495 W K T Y G I I F Q S   S P R V L W
638197195.Saci_0260                       495 W K T Y G I M S Q S   S Y R V L W
643830840.LS215_0285                      495 W K T Y G I I F Q S   S P R V L W
643882885.M164_0272                       495 W K T Y G I I M Q S   S P R V L W
650822319.Mcup_1926                       494 W K S Y G I I F Q S   S P R V L W
643836194.YG5714_0257                     495 W K T Y G I I F Q S   S P R V M W R
638163678.SSO2466                         495 W K T Y G I I F Q S   S P R V L W
650474851.SIH_0261                        495 W K T Y G I I S Q S   S P K V L W
646942932.Ssol_0270                       491 W K T Y G I I F Q S   S P R V L W
643842091.M1627_0254                      495 W K T Y G I I F Q S   S P R V L W
650023511.Ssol98_01010000595              491 W K T Y G I I S Q S   S P K V L W
```

| | | 501 | 511 | 521 |
|---|---|---|---|---|
| Conservation | | * * * * * * | * * * * * * * * * | * * * * |
| 640507264.Msed_1375 | 501 | A S A L K M L K N K | R E F R Y P K K H G | N I P L |
| 638192837.ST0591 | 500 | V A G L E M L K T K | R G N R Y P K K H G | N I P L |
| 2508724172.Met.1DRAFT_00025240 | 501 | V S A L D T L K N K | R E F R Y P K K H G | N I P L |
| 650821248.Mcup_0858 | 501 | V S A L R M L K N K | R E F R Y P K K H G | N I P L |
| 644527063.LD85_0258 | 500 | A R G L E M L R N K | R E F R Y P K K H G | N I P L |
| 643842089.M1627_0252 | 500 | A R G L E M L R N K | R E F R Y P K K H G | N I P L |
| 643841499.YN1551_2860 | 500 | A R G L E M L R N K | R E F R Y P K K H G | N I P L |
| 643828151.M1425_0252 | 500 | A R G L E M L R N K | R E F R Y P K K H G | N I P L |
| 643836192.YG571-4_0255 | 500 | A R G L E M L R N K | R E F R Y P K K H G | N I P L |
| 643830838.LS215_0283 | 500 | A R G L E M L R N K | R E F R Y P K K H G | N I P L |
| 646942930.Ssol_0268 | 500 | S R G L E I L R N K | R E F R Y P K K H G | N I P L |
| 650023513.Ssol98_0101000000605 | 500 | S R G L E I L R N K | R E F R Y P K K H G | N I P L |
| 643882883.M164_0270 | 500 | A R G L E M L R N K | R E F R Y P K K H G | N I P L |
| 650474849.SiH_0259 | 500 | A R G L E M L R N K | R E F R Y P K K H G | N I P L |
| 650472091.SiRe_0252 | 500 | A R G L E M L R N K | R E F R Y P K K H G | N I P L |
| 650848360.Ahos_2117 | 499 | V S A L E M L R N K | R E Y R Y P K K H G | N I P L |
| 2524413482.SacN8_01275 | 488 | Y S A L E M L K N K | R E Y R Y P K K H G | N I P L |
| 638197197.Sai_0262 | 488 | Y S A L E M L K N K | R E Y R Y P K K H G | N I P L |
| 638163676.SSO2463 | 500 | A R G L E M L R N K | R E F R Y P K K H G | N I P L |

| | 1 | 11 | 21 | 31 | 41 | |
|---|---|---|---|---|---|---|
| Conservation | | | | | | |
| 640506312.Msed_0406 | | | | | -MVTVQDFFR | |
| 638193516.ST1190 | | | | | ·M | |
| 638195071.ST2575 | | | | | ·IDIN | |
| 641669006.Tneu_1843 | -MA | QDTQELPFNE | YIMNERWKSR | | ·YQP | |
| 650847233.Ahos_1005 | | -MSENLPFEE | RY | Q | ·IDPK | |
| 650821270.Mcup_0880 | -MSNQ | ESELNLPVKE | KIVPESLKTK | T | | |
| 638163277.SSO2041 | | | | | | |
| 638163135.SSO1903n | | | | | ·ANELIKNLVR | M |
| 638198069.Saci_1149 | | | | | ·MS | |
| 650772447.TUZN_2145 | MESLSESPSK | QEIELLPYGE | KYHP | | ·YHN | |
| 648117514.ASAC_0597 | | | | | ·MELQSLIR | |
| 2508723436.Met...1DRAFT_00017880 | | | | | | |
| 643840674.YN1551_1878 | | | | | | |
| 643383328.M164_0732 | | | | | ·ANELIKNLVR | M |
| 650472518.SiRe_0686 | | | | | ·MS | |
| 2524414348.SacN8_05595 | | | | | ·MIQDFFK | |
| 646527485.LD85_0753 | | | | MWERK | YMRNMVEIIR | |
| 646945208.Ssol_2702 | | | | RYINRRGILL | YMRNMVEIIR | |
| 650822064.Mcup_1674 | | | | RYINRRGILL | YMRNMVEIIR | |
| 643828660.M1425_0851 | | | MWERK | RYINRRGILL | | |
| 643831217.LS215_0753 | | | MWERK | | | |
| 650024986.Ssol98_01010008026 | | | | | | |
| 643831373.LS215_0923 | | | | | | |
| 643828535.M1425_0704 | | | | | | |
| 650475223.SiH_0646 | | | | | | |
| 643842477.M1627_0708 | | | | | | |
| 643836911.YG5714_0994 | | | | | | |
| 650508650.VMUT_2290 | | | | | -MSSTFN | |

Fig. 59-2

| | | 51 | | 61 | | 71 | | 81 | | 91 | | |
|---|---|---|---|---|---|---|---|---|---|---|---|---|
| Conservation | | | | | | | | | | | | |
| 640506312.Msed_0406 | 10 | K F I E F Q N - S P | N E - - K S L Q E I | V K L V G - Q L D | - - - - - - - - - - | - - L | R R F N W - - V - - |
| 638193516.ST1190 | 1 | - - - - - - - - - - | - - - - M V S Y Y E V | V R S F S - W K E | - - - - - - - - - - | - I | E K T I - - - G - - |
| 638195071.ST2575 | 1 | - F E I D L R - - - | E N R F H N Y D E L | I K T F K - W S I | - - - - - - - - - - | - P | S Y F N I - - G G R |
| 641669006.Tneu_1843 | 28 | A Y K A F H A K S L | E Q L E E F W A H V | A K E L E - W F R P | W D K V L D A S N P | P F Y R W F V G G K |
| 650847233.Ahos_1005 | 15 | P Y K Q L Y K Q S L | E E P E K F W R E M | A E G L E - W F S P | F D K V L D E S N A | P F Y K W F V G G E |
| 650821270.Mcup_0880 | 30 | D Y L T F H K L T L | D N N L E F W E S I | A K E L E - W F K P | W E R T L D S S - - | P F F Y K W F V G G E |
| 638163277.SSO2041 | 1 | - - - - - - - - - - | - M A S Y E E E V | R R R S F S - W S E | - - - - - - - - - - | - V | I K F L - - - - - - |
| 638163135.SSO1903n | 1 | - - - - - - - - - - | - M V S Y E E E V | R R R S F S - W N E | - - - - - - - - - - | - I | E D F N W - - V - - |
| 638198069.Saci_1149 | 12 | D F I D I Q K L N P | L D R P E R I N D L | F T R L N F L G K | - - - - - - - - - - | - P | E Y F N I - - G - - |
| 650772447.TUZN_2145 | 3 | E E I D L R - - - | K Y S F S S Y N E L | Y S S F F K - W N I | - - - - - - - - - - | - V | P F Y R W F V G G E |
| 648117514.ASAC_0597 | 28 | K Y V D F W R Q S L | A D P M R F W D E R | A R E L V - W Y R T | W D R V L D D S N P | T K F N W - - V - - |
| 2508723436.Met...1DRAFT_00017880 | 9 | E F I S L Q E R G F | T E - - D K I K E F | F Q N L I - K V D | - - - - - - - - - - | - L | I R Y L - - - - - - |
| 643840674.YN1551_1878 | 1 | - - - - - - - - - - | - M A S Y E E E V | R R R S F S - W S E | - - - - - - - - - - | - V | I R Y L - - - - - - |
| 643883328.M164_0732 | 1 | - - - - - - - - - - | - M A S Y E E E V | R R R S F S - W I E | - - - - - - - - - - | - V | E D F N W - - V - - |
| 650472518.SiRe_0686 | 1 | - - - - - - - - - - | - M A S Y E E E V | R R R S F S - W S E | - - - - - - - - - - | - V | I R Y L - - - - - - |
| 2524414348.SacN8_05595 | 12 | D F I D I Q K L N P | L D R P E R I N D L | F T R L N F L G K | - - - - - - - - - - | - I | Y R F N W - - V - - |
| 646527485.LD85_0753 | 1 | - - - - - - - - - - | - M A S Y E E E V | V N E L H - K L N | - - - - - - - - - - | - V | R E E L N - - - Y N |
| 646945208.Ssol_2702 | 1 | - - - - - - - - - - | - N R - - E K K I E E I | R K K N F S - W S K | - - - - - - - - - - | - V | R E E L N - - - Y N |
| 650822064.Mcup_1674 | 8 | K L V K A Q K - D L | R P N L E N Y E E E V | R K K N F S - W S K | - - - - - - - - - - | - V | R E E L N - - - - - |
| 643828660.M1425_0851 | 26 | E K K I I L - - - | R P N L E N Y E E E V | R R R S F S - W S E | - - - - - - - - - - | - V | I R Y L - - - - - - |
| 643812171.LS215_0753 | 26 | D K K I I L - - - | - - - - M A S Y E E E V | R R R S F S - W S E | - - - - - - - - - - | - V | I R Y L - - - - - - |
| 650024986.Ssol98_01010008026 | 26 | E K K I I L - - - | - - - - M A S Y E E E V | R R R S F S - W I E | - - - - - - - - - - | - V | I R Y L - - - - - - |
| 643831373.LS215_0923 | 1 | - - - - - - - - - - | - - - - M A S Y E E E V | R R R S F S - W S E | - - - - - - - - - - | - V | I R Y L - - - - - - |
| 643828535.M1425_0704 | 1 | - - - - - - - - - - | - - - - M A S Y E E E V | R R R S F S - W S E | - - - - - - - - - - | - V | I R Y L - - - - - - |
| 650475223.SiH_0646 | 1 | - - - - - - - - - - | - - - - M A S Y E E E V | R R R S F S - W S E | - - - - - - - - - - | - V | I R Y L - - - - - - |
| 643842477.M1627_0708 | 1 | - - - - - - - - - - | - - - - M A S Y E E E V | R R R S F S - W S E | - - - - - - - - - - | - V | I R Y L - - - - - - |
| 643836911.YG5714_0994 | 1 | - - - - - - - - - - | - - - - M A S Y E E E V | R R R S F S - W S E | - - - - - - - - - - | - V | I R Y L - - - - - - |
| 650508650.VMUT_2290 | 8 | E F L K Q R N L L L | N A - - G S Y E E A | R S N F R - W P P | - - - - - - - - - - | - H | G E F N W - - - A - |

Fig. 59-3

| | 101 | 111 | 121 | 131 | 141 | |
|---|---|---|---|---|---|---|
| Conservation | | | | | | |
| 640506312.Msed_0406 | 42 RDVFED··I | HVKER·G··S | KTALIWR··· | ·········· | AKLSYHELSL | |
| 638193516.ST1190 | 21 ······DI | ··SSLVDHE | GVAVIRFS·· | ·········· | EQITFQELKD | |
| 638195071.ST2575 | 33 ··EAILDR | KIREGLG··N | NVAVYYED·· | ·········· | HELSYHELKD | |
| 641669006.Tneu_1843 | 77 LNLSYLAVDR | HVKKTWRK·· | KLAIEWEGEP | VDGNGEPTER | SVYTFSQLKR | |
| 650847233.Ahos_1005 | 64 INITYNALDR | QVKV·RR··· | KIAIYWENEK | ··EEGNH | RKLTYFDLYR | |
| 650821270.Mcup_0880 | 79 LNASYLAVDR | HFRSWR···· | KVALIWEGEP | ··GES·· | RQLTYGELYN | |
| 638163277.SSO2041 | 21 ······DE | NPLDVLTSHD | GIAIKRFT·· | ·SPREV | RKLTYLDLFR | |
| 638163135.SSO1903n | 21 ······DK | NPLDVLTSND | GIAIKRFT·· | ·K·NAM | EEISFSDLKR | |
| 638198069.Saci_1149 | 48 RDIYEE··I | HVKDR·G··G | KTALMWY··· | ·K·DVV | EDISFSDLLI | |
| 650772447.TUZN_2145 | 34 ·YAIIDR | NVERGFG··· | RLAIYYLD·· | ·DLDTKVE | EIYTYQDLLI | |
| 648117514.ASAC_0597 | 77 TNVNLNALDR | WMNTHVA··N | KVAYYWEGED | ·DEGNR | YSLTFGELKR | |
| 250872343.Met..1DRAFT_00017880 | 42 RDVVEQ··V | HLKDR·G··S | KTALHWR··· | ··GTT | RVLSYRDLFR | |
| 643840674.YN1551_1878 | 21 ······DE | NPLDVLTSHD | GIAVKRFT·· | ·DMSTGEE | ETLTYHQLSL | |
| 643883328.M164_0732 | 21 ······DK | NPLDVLTSND | GIAVRRFT·· | ·K·NAM | EEISFSDLKR | |
| 650472518.SiRe_0686 | 21 ······DK | NTLDVLTSHD | GIAVKRVT·· | ·K·NAV | EKISFSDLKR | |
| 252441434.SacN8_05595 | 48 RDIYEE··I | HVKDR·G··G | KTALMWY··· | ·DLDTKVE | EIYTYQDLLI | |
| 646527485.LD85_0753 | 21 ······DE | NPLDVLTSHD | GIAVKRFT·· | ·K·NAM | EEISFSDLKR | |
| 646945208.Ssol_2702 | 21 ······DE | HVKER·A··S | KTALVWR··· | ·DMDSKDE | SRLTYYEMDV | |
| 650822064.Mcup_1674 | 40 RDVFEQ··T | HKKGELG··D | KYGILWVS·· | EEEEK | RKKYTFRDLER | |
| 643828660.M1425_0851 | 58 GDVNAAELAI | HKKGELG··D | KYGILWVS·· | EDDEK | RKKYTFRDLEK | |
| 643831217.LS215_0753 | 58 GDVNAAELAI | NPLDVLTSND | KYGILWVS·· | ·K·NAM | EEISFSDLKR | |
| 650024986.Ssol98_01010008026 | 58 GDVNAAELAI | NPLDVLTSND | GIAVRRFT·· | ·K·NAM | EKISFSDLKR | |
| 643831373.LS215_0923 | 21 ······DK | NTLDVLTSND | GIAVKRVT·· | ·K·NAV | EEISFSDLKR | |
| 643828535.M1425_0704 | 21 ······DK | NPLDVLTSHD | GIAVRRFT·· | ·K·NAM | EEISFSDLKR | |
| 650475223.SiH_0646 | 21 ······DE | NPLDVLTSHD | GIAVKRFT·· | ·K·NAM | EEISFSDLKR | |
| 643842477.M1627_0708 | 21 ······DK | NPLDVLTSND | GIAVRRFT·· | ·K·NAM | EKISFSDLKR | |
| 643836911.YG5714_0994 | 21 ······DE | NPLDVLTSHD | GIAVKRFT·· | ·K·NAM | EEISFSDLKR | |
| 650508650.VMUT_2290 | 41 VDYFDK···Y | LAET··S··I | NPALIYINDE | ·LFKSGDS | RILSYHELRA | |

| | | 201 | | 211 | | 221 | | 231 | | 241 | | |
|---|---|---|---|---|---|---|---|---|---|---|---|---|
| Conservation | | | | | | | | | | | | |
| 640506312.Msed_0406 | 129 | NLTVAEMKYR | FSDLKPSAI I | SDSLR---- | ---------- | ALGSL----- | |
| 638193516.STI190 | 102 | AFGPKAIEIR | TRDKKKPKKV | YQDDQ----- | ---------- | GVPLS----- | |
| 638195071.ST2575 | 119 | LMGVDAVEYR | IKQSGAKVI L | MEGSR----- | ---------- | LKNVT----R | |
| 641669006.Tneu_1843 | 175 | GFSAEALAER | INDSQSRLVV | TTDGFWRRGK | VVRLKDVVDDQ | ALEKT----P | |
| 650847233.Ahos_1005 | 153 | GFSTQAVIDR | INDAKAKLLI | TTSHTMRRGK | RVELKRIIDE | AVSQT----K | |
| 650821270.Mcup_0880 | 174 | GFSAQALADR | MNDAGAKLLI | TADGGWRR-- | VVVQL----- | ALEMN----- | |
| 638163277.SSO2041 | 105 | AFGPEAIKMR | TRDVKPKPKI F | CQDDDQ---- | ---------- | AILFS----- | |
| 638163155.SSO1903n | 105 | AFGPEAIKMR | TRDAKPKPKV F | YQDDDQ---- | ---------- | AIPFS----- | |
| 638198069.Saci_1149 | 134 | NLTAYELGYR | FADLKPKPKV I | ADPKS----- | KDKINDD---- | ALGDL----- | |
| 650772447.TUZN_2145 | 120 | LIGTEGVEYR | LRHSGAKALI | AEGAR----- | AERIDDQ--- | AIPFS----- | |
| 638117514.ASAC_0597 | 167 | GFSPSALADR | IVDAKSRVLI | TADGYWRKGK | RDVLDA---- | ALGDL----- | |
| 250872336.Met...1DRAFT_00017880 | 129 | NLTVNELKYR | FSDLKPRPKAI V | SDTLR----- | VVELKKNADE | VSKIE----- | |
| 643840674.YN1551_1878 | 105 | AFGPEAIKMR | TRDVKPKPKI F | CQDDDQ---- | ARTVEE---- | GVRLAEERGA | |
| 643883328.M164_0732 | 105 | AFGPEAIRMR | TRDVKPKPKV F | CQDDDQ---- | KDKVNNN--- | ALGEM----- | |
| 250441348.SaeN8_05595 | 135 | NLTAYELGYR | TGDVKPKPKI F | ADPKS----- | KDKINDD--- | AIS FS----- | |
| 646527485.LD85_0753 | 105 | AFGPEAIKMR | FADLKPKPKV I | CQDDDQ---- | AERIDDQ--- | AISFS----- | |
| 646945208.Ssol_2702 | 105 | AFGPEAIKMR | TRDVKPKPKI F | CQDDDQ---- | KDKINDD--- | ALGDL----- | |
| 650822064.Mcup_1674 | 127 | NLTVSELKYR | TRDVKPKPKI F | ADSLR----- | APVLEQ---- | ALGSL----- | |
| 643828660.M1425_0851 | 148 | TFGEDAIRYR | FSDLKPKPKI F | VHESL----- | AEKFRZN--- | IHGIK----- | |
| 643831217.LS215_0753 | 148 | TFGEDAIRYR | VENSGAKVAI | VHESL----- | VEKFRZN--- | IHGIK----- | |
| 650024986.SsoI98_01010000 8026 | 148 | TFGEDAIRYR | VENSGAKVAI | CQDDDQ---- | KDKIRNDD-- | AILFS----- | |
| 643831373.LS215_0923 | 105 | AFGPEAIKMR | TRDVKPKPKI F | CQDDDQ---- | KDKVNNN--- | AISFS----- | |
| 643828535.M1425_0704 | 105 | AFGPEAIKMR | TRDVKPKPKI F | CQDDDQ---- | KDKINDD--- | ALGSL----- | |
| 650475223.SIH_0646 | 105 | AFGPEAIKMR | TGDVKPKPKI F | CQDDDQ---- | KDKVNNN--- | AILFS----- | |
| 643842477.M1627_0708 | 105 | AFGPEAIKMR | TRDVKPKPKI F | CQDDDQ---- | KDKINDD--- | AISFS----- | |
| 643836911.YG5714_0994 | 105 | AFGPEAIKMR | TRDVKPKPKI F | CQDDDQ---- | KDKINDD--- | AILFS----- | |
| 650508650.VMUT_2290 | 130 | LLLPSDIEDR | TSRAHFKKAI I | ADPEV----- | VSRIDQ---- | IKGNL----- | |

Fig. 59-6

| | | 251 | | 261 | | 271 | | 281 | | 291 | | |
|---|---|---|---|---|---|---|---|---|---|---|---|---|
| Conservation | | | | | | | | | | | | |
| 640506312.Msed_0406 | 165 | - - K V E - - - - K | | F L I - D G K R E T | | W - N S L - E D - | | - - - - - | | P E D T R G E D | W D D P V I |
| 638193516.STI190 | 138 | - - - K - - - - - - | | - - - - - - - - - - | | - - - - - - E D - | | - - - - - | | I E R L S W N | D D D P I |
| 638195071.ST2575 | 155 | - - - K - - - I - - | | - V - D G E A N R | | - - - - - - L T | | - - - - - | | A V N T G S E | A D D P A |
| 641669006.Theu_1843 | 221 | T V E N V I V Y S R | | L G L K D V P M T E | | E N E I E F D E V K | | - - - - - | | P E P L E S E | E H P S |
| 650847233.Abos_1005 | 199 | S V E K V L V I K - | | R D - E E I E L N E | | E R D Y W H R V M | | - - - - - | | P E E T L S T D | W D P L |
| 650821270.Mcup_0880 | 220 | S I K D V I V V R R | | T G - S E V R M E K | | G R D S F L H D L M | | - - - - - | | P E R V K S E | D D P L |
| 638163277.SSO2041 | 141 | - - - K - - - - - - | | - - - - - - - - - - | | - - - F D E L L - | | - - - - - | | I E K I N W | W D D A I |
| 638163135.SSOI903n | 141 | - - - K - - - - - - | | - - - - - - - - - - | | - - - F D E L L - | | - - - - - | | I E K I N W | W D D P I |
| 638198069.Saci_1149 | 170 | - - - K P L - - - - | | - I V V - R G R V N G | | W - T D F - E L T Q | | - S E S E S A E | | A Y P T S S E | D D D I |
| 650772447.TUZN_2145 | 156 | - - - H L R A I - - | | Y V V - G S E P R G | | G K E Y S L E D Q S | | - R S G R R I D | | A V A T R S E | A D D P A |
| 648117514.ASAC_0597 | 217 | K V D K V I V V R R | | L G - N Q V A W N E | | G R D V W Y H E L V | | - S K Y P E N T Y V K | | P V P R K A D | D D V L |
| 2508723436.Met...IDRAFT_00017880 | 165 | - - - K V E - - - - | | F L I - D G K K Q G | | W - N S L - E D G - | | - - - - - | | A E D T M G N | D D V V |
| 643840674.YN1551_1878 | 141 | - - - K - - - - - - | | - - - - - - - - - - | | - - - F D E L L - | | - S Y G E L K E | | I E K I N W | W D D A I |
| 643883328.M164_0732 | 141 | - - - K - - - - - - | | - - - - - - - - - - | | - - - F D E L L - | | - S Y G E L K E | | I E K I N W | W D D A I |
| 650472518.SRe_0686 | 171 | - - - K P L - - - - | | - I V V - R G R V N G | | W - T D F - E L T Q | | - S E S E S A E | | A Y P T S S E | D D D I |
| 2524414348.SacN8_05595 | 141 | - - - K - - - - - - | | - - - - - - - - - - | | - - - F D E L L - | | - S Y G E L K E | | I E K I N W | W D D A I |
| 646527485.LD85_0753 | 141 | - - - K - - - - - - | | - - - - - - - - - - | | - - - F D E L L - | | - S Y G E L K E | | I E K I N W | W D D A I |
| 646945208.Ssol_2702 | 163 | - - - P V K - - - K | | F L I - D D K K W G | | W - - - - - E E - | | - E S T N A E | | P T D T Y K D | D D V V |
| 638220064.Mcup_1674 | 184 | - I L K I T - - - D | | D G I - E G E S N R | | G - - - - - - - | | - V E I S - | | Y T K R S I N | D D P F |
| 643828660.M1425_0851 | 184 | - I L K I T - - - D | | D G I - E G E L N R | | G - - - - - - - | | - V E I S - | | Y T K R S I N | D D P F |
| 643831217.LS215_0753 | 184 | - I L K I T - - - D | | D G I - E G E S N R | | G - - - - - - - | | - V E I S - | | Y T K R S I N | D D P F |
| 650024986.Ssol98_01010008026 | 141 | - - - K - - - - - - | | - - - - - - - - - - | | - - - F D E L L - | | - S Y G E L K E | | I E K I N W | W D D A I |
| 643831373.LS215_0923 | 141 | - - - K - - - - - - | | - - - - - - - - - - | | - - - F D E L L - | | - S Y G E L K E | | I E K I N W | W D D A I |
| 643828535.M1425_0704 | 141 | - - - K - - - - - - | | - - - - - - - - - - | | - - - F D E L L - | | - S Y G E L K E | | I E K I N W | W D D A I |
| 650475223.SiH_0646 | 141 | - - - K - - - - - - | | - - - - - - - - - - | | - - - F D E L L - | | - S Y G E L K E | | I E K I N W | W D D A I |
| 643842477.M1627_0708 | 141 | - - - K - - - - - - | | - - - - - - - - - - | | - - - F D E L L - | | - S Y G E L K E | | I E K I N W | W D D A I |
| 643836911.YG5714_0994 | 141 | - - - K - - - - - - | | - - - - - - - - - - | | - - - F D E L L - | | - S Y G E L K E | | I E K I N W | W D D A I |
| 650508650.VMUT_2290 | 166 | - - - E K L G V K Y | | F I T L G K P G P G | | W - L D Y Y E L I S | | - G R S E N F Q | | G V K T K S | D D D L L |

Fig. 59-7

|  | 301 | 311 | 321 | 331 | 341 |
|---|---|---|---|---|---|
| Conservation |  | * * * . . * | * . . . * * * * | | |
| 64050632.Msed_0406 | 200 INYFTSGTTG | MPKRVIHTAV | SYPVGSITT- | -ASIVGVRE | SDLHLNLSAT |
| 638193516.ST1190 | 161 ILLLYFTSGSTG | LPKGALISKR | -LLLNTYV-- | YMKYGIGLRE | NDIFWNGADP |
| 638195071.ST2575 | 192 QLFYTSGSTG | APKGVLHAHR | -FLLGHIPTY | QLYFEMAPKE | EDVFYTPADW |
| 641669006.Theu_1843 | 271 FILLYFTSGTTG | KPKGIVHDTG | GWAVHVYAT- | -MKWVFDLRE | EDVYWCTADV |
| 650847233.Ahos_1005 | 246 FILLLYFTSGTTG | KPKGILHLHG | GYGLWTYLT- | -TQWVFDLRD | TDDVFFNTADI |
| 650821270.Mcup_0880 | 269 YILLLYFTSGTTG | KPKGIVHDTG | GYMTLLHLT- | -MRQVFDLRD | EDVYWCTADV |
| 638163277.SSO2041 | 164 IILLLYFTSGTTG | APKGALIAKR | -LFLNIYV-- | YMKYGIGIRE | NDVFWNPADP |
| 638163135.SSO1903n | 164 VLLLLYFTSGTTG | APKGALIAKR | -LFLNIYV-- | YMKYGIGIRD | SDVFWNPADP |
| 638195069.Saci_1149 | 208 LNYFTSGTTG | TPKGALIAKR | SYPLGHLST- | -ASIIGVST | EDIHLNLSAP |
| 650772447.TUZN_2145 | 197 QLFYTSGTTG | PPKGVLHAHR | -FLLGHVPTY | QLYFEMAPRE | DDVFWTNADW |
| 648117514.ASAC_0597 | 201 FILLLYFTSGSTG | KPKGIMHSVG | GYMVYYNV- | -FKWNWDIRP | EDVHWTMADV |
| 2508723436.Met...1DRAFT_00017880 | 164 IILLLYFTSGTTG | TPKGALIAKR | -LLLLNTYV-- | YMKYGIGVKE | NDRHLNLSAT |
| 643840674.YN1551_1878 | 164 IILLLYFTSGTTG | TPKGALIAKR | -LLLLNTYV-- | YMKYGIGIRE | NDVFWNPADP |
| 643883328.M164_0732 | 164 IILLLYFTSGTTG | TPKGALIAKR | -LLLLNTYV-- | YMKYGIGIRE | NDVFWNPADP |
| 650472518.SiRe_0686 | 164 IILLLYFTSGTTG | TPKGALIAKR | SYPLGHLST- | -ASIIGVST | EDIHLNLSAP |
| 2524414348.SacN8_05595 | 209 LNYFTSGTTG | TPKGALIAKR | -LFLNIYV-- | YMKYGIGVRE | NDVFWNPADP |
| 646527485.LD85_0753 | 164 IILLLYFTSGTTG | TPKGALIAKR | SYPLGSITT- | -ASFMGINE | EDVFWHLSAT |
| 646945208.Ssol_2702 | 164 IILLLYFTSGTTG | MPKRVLHTAT | -LFLNIYV-- | -ASFMGINE | EDVFWHLSAT |
| 650822064.Mcup_1674 | 198 LNYFTSGTTG | MPKRVLHTAT | -LLTFFYYVSG | -KYHFDMHP | QDDVFWHTGDP |
| 643828660.M1425_0851 | 214 LILLLYFTSGTTG | KPKGIWHSQD | -ILTFFYYVSG | -KYHFDMHP | QDDVFWHTGDP |
| 643831217.LS215_0753 | 214 LILLLYFTSGTTG | KPKGIWHSQD | -LFLNIYV-- | -KYHFDMHP | QDDVFWNPADP |
| 650024986.Ssol98_01010008026 | 214 LILLLYFTSGTTG | KPKGIWHSQD | -LFLNIYV-- | YMKYGIGVRE | NDVFWNPADP |
| 643831373.LS215_0923 | 164 IILLLYFTSGTTG | TPKGALIAKR | -LLLNTYV-- | YMKYGIGIRE | NDVFWNPADP |
| 643828535.M1425_0704 | 164 IILLLYFTSGTTG | TPKGALIAKR | -LFLNIYV-- | YMKYGIGVRE | NDVFWNPADP |
| 650475223.SiH_0646 | 164 IILLLYFTSGTTG | TPKGALIAKR | -LFLNIYV-- | YMKYGIGVRE | NDVFWNPADP |
| 643842477.M1627_0708 | 164 IILLLYFTSGTTG | TPKGALIAKR | -LFLNIYV-- | YMKYGIGIRE | NDVFWNPADP |
| 643836911.YG5714_0994 | 164 IILLLYFTSGTTG | TPKGALIAKR | -LFLNIYV-- | YMKYGIGVRE | NDVFWNPADP |
| 650508650.VMUT_2290 | 209 LVYFTSGTTA | KPKMVMHTQS | SYPIGHLTT- | -MYWVGAKP | GYKHMNISSP |

| | | 401 | | 411 | | 421 | | 431 | | 441 | |
|---|---|---|---|---|---|---|---|---|---|---|---|
| Conservation | | | | | | | | * | * | | |
| 640506312.Msed_0406 | 294 | APPTAWRQF | I | TLD- | ---LDQF | RFERLRSVVS | - | AGEPLNPEVI | | KIWKDKFN | - |
| 638193516.ST1190 | 253 | WAPTTYRI | IS | RSV- | --KRKDY | DLKLER-ASS | - | AGEPLNPEVI | | KWFKDNYN | - |
| 638195071.ST2575 | 288 | IPPTALRMIR | | REVS | PTKDY | DLKLRA-HSS | - | AGEAVGEELI | | EWAMKELS | - |
| 641669906.Tneu_1843 | 367 | TSPTAIRMFM | | RYGE | EWPRRRH | DLSTLR-ILGS | - | VGEPINPEAW | | RWAYKVLGN | E |
| 650847233.Ahos_1005 | 342 | TSPTAIRSLM | | KYGE | RWITKH | DVSIRL-IHHS | - | VGEPINPEAW | | RWFFKNVGN | S |
| 650821270.Mcup_0880 | 365 | TSPTAIRTFM | | RQGE | RWITKH | DVSIRL-IHHS | - | VGEPINPEAW | | RWFFKLVGR | - |
| 638163277.SSO2041 | 256 | FAPTAYRMIA | | GTV- | --KKRKY | DLVLER-ASS | - | AGEPLNPEVI | | RWFMDKYN | - |
| 633163135.SSO1903n | 256 | FAPTAYRMIA | | GTI- | --KRRKY | DLVLEER-ASS | - | AGEPLNPEVI | | RWFMDKYN | - |
| 633198069.Saci_1149 | 302 | APPTAWRLFN | | LVD- | --LWKF | KFHKLRN-VVS | - | AGEPLNPEII | | KVWKDKFD | - |
| 650772447.TUZN_2145 | 293 | ITPTALRMIR | | REYP | QPLKDF | GLRLRA-VST | - | AGEAPGRELV | | EWASQAFR | - |
| 648117514.ASAC_0597 | 362 | TSPTALRMLR | | QYGD | EWVKKH | DLSTLR-ILGT | - | VGEPINPDVW | | KWYFEVVGR | G |
| 2508723436.Met...IDRAFT_00017880 | 295 | APPTAWRQFV | | TLN- | --LKEF | RMDKLR-SVVS | - | AGEPLNPEVM | | KAWREGTG | - |
| 643840674.YN1551_1878 | 256 | FAPTAYRMIA | | GTV- | --KKKKY | DLVLER-ASS | - | AGEPLNPEVI | | RWFMDKYN | - |
| 643833328.M164_0732 | 256 | FAPTAYRMIA | | GMV- | --KKKKY | DLVLER-ASS | - | AGEPLNPEVI | | RWFMDKYN | - |
| 650472518.SiRe_0686 | 256 | FAPTAYRMIA | | LVD- | --LWKK | DLVLEER-ASS | - | AGEPLNPEII | | KVWKDKFD | - |
| 2524414348.SacN8_05595 | 303 | APPTAWRLFN | | GTV- | --KKKKY | DLVLER-ASS | - | AGEPLNPEVI | | RWFMDKYN | - |
| 646527485.LD85_0753 | 256 | FAPTAYRMIA | | GTV- | --LGAY | KLDRLR-SIVA | - | AGEPLNPEVI | | KLWKEKF | G |
| 646945208.Ssol_2702 | 256 | FAPTAYRMIA | | GLE- | --LAKKKY | DLSSVRF-VHA | - | AGEPLNPEVI | | KAGIEIFG | - |
| 650822064.Mcup_1674 | 292 | APPTAWRQFI | | KEGL | ELAKKKY | DLSSVRF-VHA | - | GGEYVDPDTV | | KAGIEIFG | - |
| 643828660.M1425_0851 | 305 | TAPTALRLLK | | KEGL | ELAKKKY | DLSSVRF-VHA | - | GGEYVDPDTV | | KAGIEIFG | - |
| 643831217.LS215_0753 | 305 | TAPTALRLLK | | GTV- | --KKKKY | DLVLEER-ASS | - | AGEPLNPEVI | | RWFMDKYN | - |
| 650024986.Ssol98_01010008026 | 305 | TAPTALRLLK | | GMV- | --KKKKY | DLVLEER-ASS | - | AGEPLNPEVI | | RWFMDKYS | - |
| 643831373.LS215_0923 | 256 | FAPTAYRMIA | | GTV- | --KKKKY | DLVLEER-ASS | - | AGEPLNPEVI | | RWFMDKYN | - |
| 650475223.SiH_0646 | 256 | FAPTAYRMIA | | GMV- | --KKKKY | DLVLEER-ASS | - | AGEPLNPEVI | | RWFMDKYN | - |
| 643842477.M1627_0703 | 256 | FAPTAYRMIA | | LED- | --LTKY | NLEKIKSFVS | - | ERVYKATG | | ERVYKATG | - |
| 643836911.YG5714_0994 | 256 | FAPTAYRMIA | | | | | | | | | |
| 650508650.VMUT_2290 | 303 | APPTVWRMI | | | | | | | | | |

| | | 701 | | | | | | | | | | 711 | |
|---|---|---|---|---|---|---|---|---|---|---|---|---|---|
| Conservation. | | | | | | | | | | | | | |
| 640506312.Msed_0406 | 564 | . | . | . | . | . | . | . | . | . | . | . | . |
| 638193516.ST1190 | 497 | . | . | . | . | . | . | . | . | . | . | . | . |
| 638195071.ST2575 | 544 | . | . | . | . | . | . | . | . | . | . | . | . |
| 641669006.Tneu_1843 | 661 | R | E | I | A | R | V | . | . | . | . | . | . |
| 650847233.Abos_1005 | 636 | K | E | I | Q | G | Q | Q | N | E | K | . | . |
| 650821270.Mcup_0880 | 658 | R | E | V | K | K | . | . | . | . | . | . | . |
| 638163277.SSO2041 | 498 | . | . | . | . | . | . | . | . | . | . | . | . |
| 638163135.SSO1903n | 497 | . | . | . | . | . | . | . | . | . | . | . | . |
| 638198069.Saci_1149 | 573 | . | . | . | . | . | . | . | . | . | . | . | . |
| 650772447.TUZN_2145 | 555 | . | Q | M | R | . | . | . | . | . | . | . | . |
| 648117514.ASAC_0597 | 656 | S | Q | M | R | . | . | . | . | . | . | . | . |
| 2508723436.Met...1DRAFT_00017880 | 567 | . | . | . | . | . | . | . | . | . | . | . | . |
| 643840674.YN1551_1878 | 498 | . | . | . | . | . | . | . | . | . | . | . | . |
| 643883328.M164_0732 | 498 | . | . | . | . | . | . | . | . | . | . | . | . |
| 650472518.SiRe_0686 | 498 | . | . | . | . | . | . | . | . | . | . | . | . |
| 2524414348.SacN8_05595 | 574 | . | . | . | . | . | . | . | . | . | . | . | . |
| 646527485.LD85_0753 | 498 | . | . | . | . | . | . | . | . | . | . | . | . |
| 646945208.Ssol_2702 | 498 | . | . | . | . | . | . | . | . | . | . | . | . |
| 650822064.Mcup_1674 | 562 | . | . | . | . | . | . | . | . | . | . | . | . |
| 643828660.M1425_0851 | 583 | . | . | . | . | . | . | . | . | . | . | . | . |
| 643831217.LS215_0753 | 583 | . | . | . | . | . | . | . | . | . | . | . | . |
| 650024986.Ssol98_01010008026 | 583 | . | . | . | . | . | . | . | . | . | . | . | . |
| 643831373.LS215_0923 | 498 | . | . | . | . | . | . | . | . | . | . | . | . |
| 643828535.M1425_0704 | 498 | . | . | . | . | . | . | . | . | . | . | . | . |
| 650475223.SiH_0646 | 498 | . | . | . | . | . | . | . | . | . | . | . | . |
| 643842477.M1627_0708 | 498 | . | . | . | . | . | . | . | . | . | . | . | . |
| 643836911.YG5714_0994 | 498 | . | . | . | . | . | . | . | . | . | . | . | . |
| 650508650.VMUT_2290 | 583 | . | . | . | . | . | . | . | . | . | . | . | . |

| | | 51 | | 61 | | 71 | | 81 | | 91 | |
|---|---|---|---|---|---|---|---|---|---|---|---|
| Conservation | | : | : | : | * | * | : | * | : | * | : |
| 640507210.Msed_1321 | 48 | FDAAWEED- | - | ---- | TKELGR | AWSPYLEEEI | NRFNHIHRSP | DDLAAKVKLL |
| 650821278.Mcup_0888 | 25 | FDAAWQED- | - | ---- | TKELGR | AWSPYLEEEI | NRFNHIHRSP | EDLAAKVKLL |
| 2511627386.TTX_1102 | 48 | FDAAFDED- | - | ---- | TRALAR | VKSPFIGEEI | NRFVHIHRSP | EDLVAKVKLL |
| 650848279.Ahos_2036 | 48 | FDSAWDED- | - | ---- | TKDLAR | AWSPFINEEV | NRFNHIHRSP | EDLAAKVKLL |
| 650024685.Ssol98_01010006527 | 48 | YDAAHEED- | - | ---- | SESLAR | AYSPFINEEV | NRFTHIHRSP | EDLAAKVKLL |
| 638163940.SSO2738 | 48 | YDAAHEED- | - | ---- | TRGLAR | AWSPFIGEEV | NRFNHIHQSP | EDLAAKVKLL |
| 638171713.PAE2693 | 48 | FDAAFDED- | - | ---- | TKELGR | AWSPFINEEI | NRFVHIHRSP | EDLAAKVKLL |
| 638194068.ST1659 | 48 | FDAAWEED- | - | ---- | TKELGR | AWSPFIEEEV | NRFNHIHRSP | QDLAAKVKLL |
| 2508721913.Met...IDRAFT_00002650 | 48 | FDAAWQED- | - | ---- | TKELGR | VYSPIVGEEI | NRFNSLHTSP | EDLAAKVKLL |
| 2512378777.Pogu_1298 | 48 | FDAAFEED- | - | ---- | TKDLAR | AWSPYLEEEV | NRFNHIHRSP | QDLAAKVKLL |
| 638199056.Saci_2143 | 48 | FDAAWDED- | - | ---- | TKELGR | VYSPIVGEEI | NRFNSIHMGP | ADLVAKVKLL |
| 2524415311.SacN8_10430 | 48 | FDAAWDED- | - | ---- | TRDLAR | AYSPFINEEV | NRFVHIHQSP | EDLVAKVKLL |
| 640125146.Pcal_1396 | 50 | FDAAHEED- | - | ---- | TRDLAR | AWSPFAGEEI | NRFTHIHRSP | EDLAAKVKLL |
| 641667580.Tneu_0422 | 48 | FDAAFQED- | - | ---- | TRDLAR | AYSPFINEEV | NRFTHIHQSP | EDLVAKVKLL |
| 2511694157.P186_0718 | 48 | FDAAFQED- | - | ---- | SKSLGR | AWSPFINEEV | NRFTHIHRSP | EDLAAKVKLL |
| 644833127.LS215_2744 | 48 | YDAAHEED- | - | ---- | SKSLGR | AWSPFINEEV | NRFTHIHRSP | EDLAAKVKLL |
| 644830347.M1425_2585 | 48 | YDAAHEED- | - | ---- | SKSLGR | AWSPFINEEV | NRFTHIHRSP | EDLAAKVKLL |
| 644844328.MI627_2638 | 48 | YDAAHEED- | - | ---- | TRDLAR | AWSPFINEDV | NRFVHIHRSP | QDLAAKVKLL |
| 639783328.Ptsl_0248 | 48 | FDAAFQED- | - | ---- | SKSLGR | AYSPFINEEV | NRFTHIHRSP | EDLVAKVKLL |
| 650477167.SiH_2522 | 48 | YDAAHEED- | - | ---- | SGVHLAK | AYSPFFINEEV | NRFNHIHQSP | EDLAAKVKLL |
| 644839021.YN1551_0139 | 49 | YKAPWDPYFY | - | DKEMG | SKSLGR | AWSPFINEEV | NRFTHIHRSP | QDLAIKVKLY |
| 640897163.Igni_0595 | 48 | YDAAHEED- | - | ---- | SKSLGR | AWSPFINEEV | NRFTHIHRYP | EDLAVKVKLL |
| 643885186.M164_2569 | 48 | YDAAHEED- | - | ---- | SKSLGR | AWSSFINEEV | NRFTHIHRSP | EDLAAKVKLL |
| 650474246.SiRe_2362 | 48 | YDAAHEED- | - | ---- | SESLAR | AWSSFINEEV | NRFTHIHRSP | EDLAAKVKLL |
| 643838664.YG5714_2751 | 48 | YDAAHEED- | - | ---- | SKSLGR | AWSSFINEEV | NRFTHIHRSP | EDLAAKVKLL |
| 646943192.Ssol_0550 | 48 | YDAAHEED- | - | ---- | SKSLGR | AWSSFINEEV | NRFTHIHRSP | EDLAAKVKLL |
| 646529546.LD85_2896 | 48 | YDAAHEED- | - | ---- | SKSLGR | AWSSFINEEV | NRFTHIHRSP | EDLAAKVKLL |

| | | 301 | | | | | 311 | | | | | | | 321 | | | | | | | 331 | | | | | | | 341 | | | | | | |
|---|---|---|---|---|---|---|---|---|---|---|---|---|---|---|---|---|---|---|---|---|---|---|---|---|---|---|---|---|---|---|---|---|---|---|---|
| Conservation | | . | . | . | . | * | * | . | . | . | * | * | * | * | . | * | * | * | * | * | * | . | * | * | * | * | * | . | . | . | . | . | . | . | * |
| 640507210.Msed_1321 | 280 | Y | T | G | T | L | V | E | I | F | S | A | Y | H | R | Q | G | Y | G | G | C | K | A | G | L | G | D | V | I | I | G | A | S | A | D | L | A | K | Q | I | G | V | D | R | A | S | H | V | Q | D | K |
| 650821278.Mcup_0888 | 257 | Y | T | G | T | L | V | E | I | F | S | A | Y | H | R | Q | G | Y | G | G | C | K | A | G | L | G | D | V | I | I | G | A | S | A | D | L | A | K | Q | I | G | V | E | K | A | S | H | V | Q | D | K |
| 2511627386.TTX_1102 | 280 | H | S | G | E | L | V | E | I | F | A | S | F | H | R | Q | G | Y | A | G | C | K | S | G | L | G | D | V | I | I | G | A | S | F | N | L | A | R | Q | L | G | I | A | D | K | P | H | V | Q | E | K |
| 650848279.Ahos_2036 | 280 | Y | T | S | Q | L | V | E | I | F | S | A | Y | H | R | Q | G | Y | G | G | C | K | A | G | L | G | D | V | I | I | G | A | T | Y | N | L | A | K | Q | I | G | V | E | K | A | P | H | V | Q | D | K |
| 650024685.Ssol98_010100006527 | 278 | M | S | G | I | L | V | E | I | F | S | S | Y | H | R | Q | G | Y | G | G | C | K | S | G | L | G | D | V | I | I | G | A | A | Y | N | L | A | K | Q | I | G | V | E | K | A | P | H | I | Q | N | K |
| 638163940.SSO2738 | 278 | M | S | G | I | L | V | E | I | F | S | S | Y | H | R | Q | G | Y | G | G | C | K | S | G | L | G | D | V | I | I | G | A | A | Y | N | L | A | K | Q | I | G | V | E | K | A | S | H | V | Q | E | K |
| 638171713.PAE2693 | 281 | W | S | G | V | F | V | E | V | F | S | N | Y | H | R | Q | G | Y | G | G | C | K | A | G | L | G | D | V | I | I | G | A | S | Y | G | L | A | R | R | L | G | V | E | K | A | P | H | I | Q | E | K |
| 638194068.ST1659 | 280 | F | T | S | Q | L | V | E | I | F | S | A | Y | H | R | Q | G | Y | G | G | C | K | A | G | L | G | D | V | I | I | G | A | S | M | N | L | A | K | Q | I | G | V | E | K | A | S | H | V | Q | D | K |
| 2508721913.Met..IDRAFT_00002650 | 280 | Y | T | G | T | L | V | E | I | F | S | A | Y | H | R | Q | G | Y | G | G | C | K | A | G | L | G | D | V | I | I | G | A | S | A | D | L | A | K | Q | I | G | V | E | K | A | P | H | V | Q | D | K |
| 2512378777.Pogu_1298 | 280 | E | A | G | V | L | V | E | I | F | A | A | Y | H | R | Q | G | Y | A | G | C | K | S | G | L | G | D | V | I | I | G | A | T | H | N | L | A | K | Q | I | G | V | V | D | K | S | H | V | Q | D | K |
| 638199056.Saci_2143 | 280 | Y | T | G | T | L | V | E | I | F | S | A | Y | H | R | Q | G | Y | G | G | C | K | A | G | L | G | D | V | I | I | G | A | S | A | D | L | A | K | Q | I | G | V | E | K | A | P | H | V | Q | D | K |
| 2524415311.SacN8_10430 | 280 | Y | T | G | T | L | V | E | I | F | S | A | Y | H | R | Q | G | Y | G | G | C | K | S | G | L | G | D | V | I | I | G | A | A | Y | N | L | A | K | Q | I | G | V | A | D | K | P | H | V | R | E | K |
| 640125146.Pcal_1396 | 283 | W | A | G | V | L | V | E | V | F | S | A | F | H | R | Q | G | Y | G | G | C | K | A | G | L | G | D | V | I | I | G | A | A | Y | N | L | A | K | Q | I | G | I | A | D | K | P | N | I | V | D | K |
| 641667580.Tneu_0422 | 279 | W | A | G | P | L | V | E | V | F | A | S | Y | H | R | Q | G | Y | G | G | C | K | S | G | L | G | D | V | I | I | G | A | A | T | Q | G | L | A | R | A | I | G | V | A | V | A | E | N | Q | N | K |
| 2511694157.P186_0718 | 281 | W | T | G | P | L | L | V | E | I | F | A | A | F | H | R | Q | G | Y | G | G | C | K | S | G | L | G | D | V | I | I | G | A | A | Y | N | L | A | K | Q | I | G | V | E | K | A | P | H | I | Q | N | K |
| 643833127.LS215_2744 | 278 | M | S | G | I | L | V | E | I | F | S | S | Y | H | R | Q | G | Y | G | G | C | K | S | G | L | G | D | V | I | I | G | A | A | Y | N | L | A | K | Q | I | G | V | E | K | A | P | H | I | Q | N | K |
| 643830347.M1425_2585 | 278 | M | S | G | I | L | V | E | I | F | S | S | Y | H | R | Q | G | Y | G | G | C | K | S | G | L | G | D | V | I | I | G | A | A | Y | N | L | A | K | Q | I | G | V | E | K | A | P | H | I | Q | N | K |
| 643844328.M1627_2638 | 278 | M | S | G | I | L | V | E | I | F | S | A | Y | H | R | Q | G | Y | G | G | C | K | S | G | L | G | D | V | I | I | G | A | A | Y | N | L | A | K | Q | I | G | V | E | K | A | P | H | I | Q | N | K |
| 639783328.Pisl_0248 | 279 | W | A | G | P | L | V | E | V | F | S | A | F | H | R | Q | G | Y | G | G | C | K | S | G | L | G | D | V | I | I | G | A | A | Y | N | L | A | K | Q | I | G | V | A | D | K | P | H | I | Q | N | K |
| 650477167.SiH_2522 | 278 | M | S | G | I | L | V | E | I | F | S | S | Y | H | R | Q | G | Y | G | G | C | K | S | G | L | G | D | V | I | I | G | A | A | Y | N | L | A | K | Q | I | G | V | E | K | A | P | H | I | Q | N | K |
| 643839021.YN1551_0139 | 278 | M | S | G | I | L | V | E | I | F | S | S | Y | H | R | Q | G | Y | G | G | C | K | P | G | L | G | D | V | I | I | G | A | G | A | Y | H | L | A | K | Q | O | M | G | I | A | N | K | C | H | I | R | E | K |
| 640897163.Igni_0595 | 299 | F | A | A | E | L | V | E | I | F | A | A | F | H | R | Q | G | Y | A | G | C | K | S | G | L | G | D | A | D | V | I | I | G | A | A | Y | N | L | A | K | Q | I | G | V | E | K | A | P | H | I | Q | N | K |
| 643885186.M164_2569 | 278 | M | S | G | I | L | V | E | I | F | S | S | Y | H | R | Q | G | Y | G | G | C | K | S | G | L | G | D | V | I | I | G | A | A | Y | N | L | A | K | Q | I | G | V | E | K | A | P | H | I | Q | N | K |
| 650474246.SiRe_2362 | 278 | M | S | G | I | L | V | E | I | F | S | S | Y | H | R | Q | G | Y | G | G | C | K | S | G | L | G | D | V | I | I | G | A | A | Y | N | L | A | K | Q | I | G | V | E | K | A | P | H | I | Q | N | K |
| 643838664.YG5714_2751 | 278 | M | S | G | I | L | V | E | I | F | S | S | Y | H | R | Q | G | Y | G | G | C | K | S | G | L | G | D | V | I | I | G | A | A | Y | N | L | A | K | Q | I | G | I | A | N | K | C | H | I | R | E | K |
| 646543192.Ssol_0550 | 278 | M | S | G | I | L | V | E | I | F | S | S | Y | H | R | Q | G | Y | G | G | C | K | S | G | L | G | D | V | I | I | G | A | A | Y | N | L | A | K | Q | I | G | V | E | K | A | P | H | I | Q | N | K |
| 646529546.LD85_2896 | 278 | M | S | G | I | L | V | E | I | F | S | S | Y | H | R | Q | G | Y | G | G | C | K | S | G | L | G | D | V | I | I | G | A | A | Y | N | L | A | K | Q | I | G | V | E | K | A | P | H | I | Q | N | K |

Fig. 60-8

| | | 351 | | | | 361 | | | | 371 | | | | 381 | | | 391 | | | | |
|---|---|---|---|---|---|---|---|---|---|---|---|---|---|---|---|---|---|---|---|---|---|
| Conservation | | | * | | * | * | | | * | * | | | | * | * | | * | * | | | * | * |
| 640507210.Msed_1321 | 330 | L T E M I F L T E T | | | | M Y S A G I A A S L | | | | N A V K M C · · D N | | | | C W V V N P M H A N | | | V T K H L V A R F P | | | |
| 650821278.Mcup_0888 | 307 | L L T E M I F L T E T | | | | M Y S A G I A A S L | | | | N A V K K L L K · D N | | | | C W V V N P M H A N | | | V T K H L V A R F P | | | |
| 2511627386.TTX_1102 | 330 | L T E M V F L L T E T | | | | M Y S A A G L A A S W | | | | E G R K L L K · D G | | | | G W V V N P M H A N | | | I T K H L V A R F P | | | |
| 650848279.Ahos_2036 | 330 | I N E M I F I F T E T | | | | M Y A A G I A A S L | | | | N G I E V C · · P G | | | | C W V V N P M Q A N | | | V T K H L V A R F P | | | |
| 650024685.Ssol98_0101O0006527 | 328 | L N E M V L L N E N | | | | M Y G S G I A A S L | | | | D A V K L C E · D G | | | | C W V V N P M F A N | | | V T K H Q L V T R F P | | | |
| 638163940.SSO2738 | 328 | L N E M V L L N E N | | | | M Y S A G L A A S L | | | | E A R K L L R · D G | | | | G W V V N P M F A N | | | V T K H Q L V T R F P | | | |
| 638171713.PAE2693 | 331 | L T E M A F L L N E T | | | | M Y S A G I A A S L | | | | N A V K L V C · · · | | | | C W V V N P M Y A N | | | V T K H L V A R F P | | | |
| 638194068.ST1659 | 330 | L T E M I F L L T E T | | | | M Y S A G I A A S L | | | | N A V K M C · · D N | | | | C W V V N P M H A N | | | V T K H L V A R F P | | | |
| 250872913.Met...1DRAFT_00002650 | 330 | L T E M V F L N E T | | | | M Y S A A G L A A S W | | | | E G R K L V D · D G | | | | G F V V N P M H A N | | | V T K H L V A K F P | | | |
| 2512378777.Pogu_1298 | 330 | L T E M V F L N E T | | | | M Y S A G I A A S L | | | | N A V K K I C · · D N | | | | C W V V N P M H A N | | | V T K H L V A R F P | | | |
| 638199056.Saci_2143 | 330 | L T E M V F L N E T | | | | M Y G S G I A A S W | | | | E G K K L V E · G D | | | | G W V V N P M H A N | | | V T K H M V A R F P | | | |
| 2524415311.SacN8_10430 | 333 | L T E M V F L N E T | | | | M Y S A G L A A S L | | | | E G K K L L L D · D G | | | | C W V V N P M F A N | | | V T K H Q L V T R F P | | | |
| 640125146.Pcal_1396 | 329 | L T E M V F L N E N | | | | M Y G S G I A A S W | | | | E W L K L C E · · | | | | C W V V N P M F A N | | | V T K H L V S R F P | | | |
| 411667580.Tneu_0422 | 331 | L A E M V F L N E T | | | | M Y S A G L A A S W | | | | D A V K L C E · · | | | | C W V V N P M F A N | | | V T K Q L V T R F P | | | |
| 2511694157.P186_0718 | 328 | L N E M V F L L N E S | | | | M Y G S G I A A S L | | | | E G K K K L L K · D G | | | | G W V V N P M F A N | | | V T K Q L V T R F P | | | |
| 643833127.LS215_2744 | 328 | L N E M V L L N E S | | | | M Y G S G I A A S L | | | | D A V K L C E · · | | | | C W V V N P M F A N | | | V T K Q L V T R F P | | | |
| 643830347.M1425_2585 | 328 | L N E M V L L N E N | | | | M Y G S G I A A S L | | | | D A V K L C E · · | | | | C W V V N P M F A N | | | V T K Q L V T R F P | | | |
| 643844338.M1627_2638 | 329 | L N E M V F L L N E N | | | | M Y G S G I A A S L | | | | E G K K K L L K · D G | | | | G W V V N P M F A N | | | V T K Q L V T R F P | | | |
| 639783328.Pisl_0248 | 329 | L T E M V F L L N E N | | | | M Y S A G L A A S W | | | | E G K K K L L K · D G | | | | C W V V N P M F A N | | | V T K H L V S R F P | | | |
| 650477167.SiH_2522 | 328 | L N E M I F L L N E S | | | | M Y G S G I A A S L | | | | D A V K L C E · · | | | | C W V V N P M F A N | | | V T K Q L V T R F P | | | |
| 643839021.YN1551_0139 | 328 | L N E M I F L L T E A | | | | M H A G G L A A A W | | | | E G K K A A · · S G | | | | T Y V V D Q M K A N | | | V T K Q L V T R F P | | | |
| 640897163.Igni_0595 | 349 | L T E M I F L L T E A | | | | M Y G S G I A A S L | | | | D A V K L C E · · | | | | C W V V N P M F A N | | | V T K Q L V T R F P | | | |
| 643885186.M164_2569 | 328 | L N E M V L L N E N | | | | M Y G S G I A A S L | | | | D A V K L C E · · | | | | C W V V N P M F A N | | | V T K Q L V T R F P | | | |
| 650174246.SiRe_2362 | 328 | L N E M V L L N E N | | | | M Y G S G I A A S L | | | | D A V K L C E · · | | | | C W V V N P M F A N | | | V T K Q L V T R F P | | | |
| 643838664.YG5714_2751 | 328 | L N E M V L L N E N | | | | M Y G S G I A A S L | | | | D A V K L C E · · | | | | C W V V N P M F A N | | | V T K Q L V T R F P | | | |
| 646943192.Ssol_0550 | 328 | L N E M V L L N E N | | | | M Y G S G I A A S L | | | | D A V K L C E · · | | | | C W V V N P M F A N | | | V T K Q L V T R F P | | | |
| 646529546.LD85_2896 | 328 | L N E M V L L N E N | | | | M Y G S G I A A S L | | | | D A V K L C E · · | | | | C W V V N P M F A N | | | V T K Q L V T R F P | | | |

Fig. 60-9

| | | 401 | 411 | 421 | 431 | 441 | |
|---|---|---|---|---|---|---|---|
| Conservation | | ..········· | *·*···*·· | *···*···· | ··*···*·· | ···*····· | * |
| 640507210.Msed_1321 | 378 | SQIAQLSIDL | AGGIVGTAPS | EWDLKNPKLK | EYISRYLQGA | EDFTAEDRLR | |
| 650821278.Mcup_0888 | 355 | SQIAQLSIDL | AGGIVGTAPS | EWDLKNPKLK | EYISRYLQGA | EDFTAEDRLR | |
| 2511627386.TTX_1102 | 379 | YEIARLSHDI | AGCILGTAPS | EADLKNPDLR | KLIEKYIQGV | PEFTAEDRLR | |
| 650848279.Abos_2036 | 378 | SQIALAIDDI | AGGILGTAPS | EWDLKNPKIK | ELLAKKYIQGM | EGYTAEDRLR | |
| 650024685.Ssoi98_0101000006527 | 377 | YEITKFSTDI | AGGIIGTAPS | EWDLKNPEIK | PLIEKYLQGV | MDYSTEDRLR | |
| 638163940.SSO2738 | 377 | YEITKFSTDI | AGGIIGTAPS | EWDLKNPELR | PLLEKYLQGV | MDYSTEDRLR | |
| 638171713.PAE2693 | 380 | YEISRLSHDI | AGGIIGTAPS | EADFKNPELL | EYIAKKYLQGV | PAEDRLR | |
| 638194068.ST1659 | 378 | AQISQLSIDL | AGGIVGTAPS | EWDLKNPKLK | EYISKYLQGV | EDYTAEDRLR | |
| 2508721913.Met...1DRAFT_00002650 | 378 | AQIAQLSIDL | AGGIVGTAPS | EWDLKNPKLK | ALIEKYLQGV | PEFTAEDRLR | |
| 2512378777.Pogu_1298 | 380 | YEIAKLSHDI | AGGLLGTAPS | EFDLKNPEIK | EYIMRYLQGV | EDFTAETRLR | |
| 638199056.Saci_2143 | 378 | AQISQLAIDI | AGGMVGTAPS | EWDLKNPKIK | EYIMRYLQGV | EDFTAEDRLR | |
| 2524415311.SacN8_10430 | 378 | AQISQLAIDI | AGGMMGTAPS | EWDLKNPKLK | KLVAKKYLQGV | EDFTAEDRLR | |
| 640125146.Peal_1396 | 383 | YEVSRLAHDI | AGGLLGTAPS | EFDLKNEPKKE | QLVEKYLQGV | PEFTAEDRLR | |
| 641667580.Tneu_0422 | 378 | YEISRLSHDI | AGGIIGTAPS | EWDLKNSEIR | HLIEKYLQGV | PDIPTEDRLR | |
| 2511694157.P186_0718 | 380 | YEVAKIAHDI | AGGIIGTAPS | EWDLKNPKLK | EEIIKYLQGV | MDYSTEDRLR | |
| 643833127.LS215_2744 | 377 | YEITKFSTDI | AGGIIGTAPS | EFDLKNPKLK | PYIEKYLQGM | MDYSTEDRLR | |
| 643830347.M1425_2585 | 377 | YEITKFSTDI | AGGIIGTAPS | EFDLKNPKLK | PYIEKYLQGM | MDYSTEDRLR | |
| 643844328.M1627_2638 | 377 | YEITKFSTDI | AGGIIGTAPS | EFDFKNPKLK | PYIEKYLQGM | PEFTAEDRLR | |
| 639783328.Pisl_0248 | 378 | YEIARLAHDI | AGGIIGTAPS | EFDFKNPKLK | PYIEKYLQGM | MDYSTEDRLR | |
| 650471167.SiH_2522 | 377 | YEITKFSTDI | AGGIIGTAPS | EWDLKNPKLK | HLVEKYLQGV | PDYPAEWRHR | |
| 643839021.YN1551_0139 | 377 | YEITKFSTDI | AGGIIGTLPS | YKDLMHEKIG | KYLQQYLQCL | MDYSTEDRLR | |
| 640897163.Igni_0595 | 397 | YEIARLAHDI | AGGIIGTAPS | EWDLKNPKLK | PYIEKYLQGM | MDYSTEDRLR | |
| 643885186.M164_2569 | 377 | YEITKFSTDI | AGGIIGTAPS | EWDLKNPKLK | PYIEKYLQGM | MDYSTEDRLR | |
| 650474246.SiRe_2362 | 377 | YEITKFSTDI | AGGIIGTAPS | EWDLKNPKLK | PYIEKYLQGM | PDYPAEWRHR | |
| 638164192.Ssol_0550 | 377 | YEITKFSTDI | AGGIIGTAPS | EWDLKNPKLK | PYIEKYLQGM | MDYSTEDRLR | |
| 646943192.Ssol_0550 | 377 | YEITKFSTDI | AGGIIGTAPS | EWDLKNPKLK | PYIEKYLQGM | MDYSTEDRLR | |
| 646529546.LD85_2896 | 377 | YEITKFSTDI | AGGIIGTAPS | EWDLKNPKLK | PYIEKYLQGM | MDYSTEDRLR | |

Fig. 60-10

| | 451 | | | | | 461 | | | | | 471 | | | | | 481 | | | | | 491 | | | | |
|---|---|---|---|---|---|---|---|---|---|---|---|---|---|---|---|---|---|---|---|---|---|---|---|---|---|
| Conservation | . | . | M | V | R | L | . | E | N | . | . | . | . | . | . | . | G | . | . | . | . | . | . | . | . | . |
| | * | * | * | * | * | * | * | * | * | * | * | * | * | * | * | * | * | * | * | * | * | * | * | * | * | * |
| 640507210.Msed_1321 | 428 | M | V | R | L | V | E | N | V | S | M | G | V | A | F | Q | I | E | S | V | H | G | A | G | G |

Fig. 60-11

| | | 501 | 511 | 521 | 531 |
|---|---|---|---|---|---|
| Conservation | | | | | |
| 640507210.Msed_1321 | 478 | R K S E V K F T S K | A E P W R E S Q S E | A E A K E A G L K S | - - - - - - - - - - |
| 650821278.Mcup_0888 | 455 | R K S S V K F T P K | A E P W R E S Q S E | T E A K E A G L K P | - - - - - - - - - - |
| 2511627386.TTX_1102 | 479 | M T N A Q - L D Q K | V E P H K K P S D A E | R , - - A K E A E K N T | - - - - - - - - - - |
| 650848279.Ahos_2036 | 478 | M K S N V K F T K K | V E P W V K E T E T E | K L A K E A E K N T | - E T A S G G K |
| 650024685.Ssol98_010100006527 | 477 | I E K R I D F K K E N | A E P W R K T D T T E | K I A S S G - - - - | - - - - - - - - - - |
| 638163940.SSO2738 | 477 | I E K R I D F K K E N | V E P W R K T D T T E | K I A S S G - - - - | - - - - - - - - - - |
| 638171713.PAE2693 | 480 | I K T A M A P D L K K | V E P H R Q T D D S E | K - L V K S - - - - | - - - - - - - - - - |
| 638194068.STI659 | 478 | K K K T D L Q W K P K | A E P W R E S E T E | S E A R E S G L K - | - - - - - - - - - - |
| 2508721913.Met...1DRAFT_00002650 | 478 | R K S E L K F T S K | A E P W R E S Q S E | K T - - - - - G L K - | - - - - - - - - - - |
| 2512378777.Pogu_1298 | 480 | M G N R R P - V D F R | V E P H K K P E A E | Q E A K E - - H D K - | - - - - - - - - - - |
| 638199056.Saci_2143 | 478 | R K A D L K M T T T K | P E P W R E T Q S E | Q E A K E - - H D K - | - - - - - - - - - - |
| 2524415311.SacN8_10430 | 478 | R K A D L K M T T T K | P E P W R E T Q S E | K A - - - - - - - - | - - - - - - - K - - |
| 640125146.Pcal_1396 | 483 | M G Q R K - A D P P R | V E P H K K P T D S E | K T - - - - - - - - | - - - - - - - Q K - |
| 641667580.Tneu_0422 | 478 | M R G P E - P P G T | P E P R R R P S D V E | K L A N N G G Q K - | - - - - - - - - - - |
| 2511694157.PI86_0718 | 480 | V K V T V K W P K E | P E P W R E S E A Q | K L A N N G G Q K - | - - - - - - - - - - |
| 643833127.LS215_2744 | 477 | I E K R I E F K K E N | A E P W R S T D T T E | K L A N N G G Q K - | - - - - - - - - - - |
| 643830347.M1425_2585 | 477 | I E K R I E F K K E N | A E P W R S T D T T E | K L A N N - - - - - | - - - - - - - - - - |
| 643844328.M1627_2638 | 477 | I E K R I E F K K E N | S E L H R K S E I E | K L - - - - - - - - | - - - - - - - Q K - |
| 639783328.Pisl_0248 | 478 | M R G P E - P P G A | A E P W R - - - - - - | Q T - - - - - - - - | - - - - - - - - - - |
| 650477167.SiH_2522 | 477 | I E K R I E F K K E N | K Q - - - - - - - K E | K L A N N G G Q K - | - - - - - - - - - - |
| 643839021.YN1551_0139 | 497 | I N P E E K P E R K K | A E P W R I D T T E | K L A N N G G Q K - | - - - - - - - - - - |
| 640897163.Igni_0595 | 477 | I E K R I E F K K E N | A E P W R - - - - - - | Q T - - - - - - - - | - - - - - - - - - - |
| 643885186.M164_2569 | 477 | I E K R I E F K K E N | - - S W R S T D T T E | K L A N N G G Q K - | - - - - - - - - - - |
| 650474246.SiRe_2362 | 477 | I E K R I D F K K E N | A E P W R S T D T T E | K I A S S G - - - - | - - - - - - - - - - |
| 643838664.YG5714_2751 | 477 | T E K R I E F K K E N | A E P W R K T D T T E | K L A N N G G - - - | - - - - - - - Q K - |
| 646943192.Ssol_0550 | 477 | I E K R I D F K K E N | A E P W R S T D T T E | K I A S S G - - - - | - - - - - - - - - - |
| 646529546.LD85_2896 | 477 | I E K R I E F K K E N | A E P W R S T D T T E | K L A N N G G Q K - | - - - - - - - - - - |

| | | 1 | | 11 | | 21 | | | | 31 | | | | 41 | | | | |
|---|---|---|---|---|---|---|---|---|---|---|---|---|---|---|---|---|---|---|
| Conservation | | | | | | | | * | * | * | | | | * | | | | |
| 640506560.Msed_0656 | - | - | - | - | - | - | - | - | - | - | G | S L K S V K P Q M | L G A I K E A L | | | | | |
| 638192756.STO514 | - | - | - | - | - | V I N M D A Y I V S | Y A R T P I G R F G | G | C V F K D L P P Y E | L G A I K E A L | | | | | | | | |
| 650770713.TUZN_0403 | - | - | - | - | - | - M R E V W I V G | A V R T P I G K F G | G | A L K D I K T A H | L G A I A F A I R K A L | | | | | | | | |
| 650821827.Mcup_1437 | - | - | - | - | - | - M R E V W I V G | A V R T P I G K F G | G | A L K D I K T A H | L G A I A F A I R K A L | | | | | | | | |
| 646942850.Ssol_0188 | - | - | - | - | E C I F | S M P E S V Y I A S | A V R T P I G K F G | G | S L K S V K P V D | L G A I V I V I R E A L | | | | | | | | |
| 643841420.YN1551_2779 | M N | - | - | - | - | - M T E V Y I A S | A V R T P I G K F G | G | C T L R N L S P V D | L G A I K E A L | | | | | | | | |
| 650848421.Ahos_2176 | M N | - | - | - | - | - M D V V Y I V S | A V R T P I G K F G | G | C V F K D I S P V D | L A A F T I K K L L | | | | | | | | |
| 641667412.Tneu_0249 | M N | - | - | - | - | - M D N V Y I V S | A V R T P I G K F G | G | G A F K D V K P P H | L G S V V I R E A L | | | | | | | | |
| 638197890.Saci_0963 | M N | - | - | - | E C I F | S M P E S V Y I A S | A V R T P I G K F G | G | S L K D V K P V D | L G S I V I R E A L | | | | | | | | |
| 650472007.SiRe_0173 | M N | - | - | - | E C I F | S M P E S V Y I A S | A V R T P I G K F G | G | G T L K N L S P V D | L G S I V I R E A L | | | | | | | | |
| 643836114.YG5714_0177 | M N | - | - | - | E C I F | S M P E S V Y I A S | A V R T P I G K F G | G | G T L K N L S P V D | L G S I V I R E A L | | | | | | | | |
| 643842011.M1627_0173 | M N | - | - | - | E C I F | S M P E S V Y I A S | A V R T P I G K F G | G | G T L K N L S P V D | L G S I V I R E A L | | | | | | | | |
| 650474766.SiH_0179 | M N | - | - | - | E C I F | S M P E S V Y I A S | A V R T P I G K F G | G | G T L K N L S P V D | L G S I V I R E A L | | | | | | | | |
| 643830761.LS215_0204 | - | - | - | - | - | - M G I V I A G | F V R T P I G K F G | G | G A L K D V K T P H | L A A F V I K A K A L | | | | | | | | |
| 640124530.Pcal_0781 | M N | - | - | - | - | L P S V E V V I V G | Y A R T P L G K F G | L | G G T L K N L S P V D | L G S I V I R E A L | | | | | | | | |
| 640467886.Pars_0309 | - | - | - | - | - | - M S E I Y I I S G | A V R T P I G K F G | G | G S L S G I P A P D | L G A I A F A I R K A L | | | | | | | | |
| 643882805.M164_0192 | M N | - | T N Y L A T S N | L P S V E V V I V G | A V R T P I G K F G | G | G C L K D V K T A H | L G A I V I V I R E A L | | | | | | | | | |
| 640897989.Igni_1401 | M N | - | T N Y L A T S N | - M S E I Y I I S G | A V R T P I G K F G | G | G T L K N L S P V D | L G A L V I K E A L | | | | | | | | | |
| 2512379618.Pogu_2093 | M N | - | - | - | E C I F | S M P E S V Y I A S | A V R T P I G K F G | G | G T L K N L S P V D | L G S I V I R E A L | | | | | | | | |
| 646526983.LD85_0177 | M N | - | - | - | E C I F | S M P E S V Y I V S | A V R T P I G K F G | G | G S L R D I S P V D | L G A I V I R K S L | | | | | | | | |
| 643828073.M1425_0173 | - | - | - | - | - | - M D N V Y V V S | A V R T P I G K F G | G | G A L R D V K T A H | L A A F A I R K A L | | | | | | | | |
| 2524414169.SacN8_04675 | - | - | - | - | - | - M R E V W I V G | A V R T P I G K F G | G | A L R N L S P V D | L G S I V I R E A L | | | | | | | | |
| 2508722819.Met...IDRAFT_00011710 | - | - | - | - | - | - M P E S V Y I A S | A V R T P I G K F G | G | A L R N L S P V D | L A A F A I R K S L | | | | | | | | |
| 2511627177.TTX_0886 | - | - | - | - | - | - M R E V W I V G | Y A R T P L G K F G | G | A L R N L S P V D | L G S I V I R E A L | | | | | | | | |
| 650024136.Ssol98_01010003733 | - | - | - | - | - | - M P E S V Y I A S | A V R T P I G K F G | G | A L R N L S P V D | L G S I V I R E A L | | | | | | | | |
| 638163597.SSO2377 | - | - | - | - | - | - M P E S V Y I A S | A V R T P I G K F G | G | A L R N L S P V D | L A A F A I R K S L | | | | | | | | |
| 648117228.ASAC_0321 | - | - | M P | K L K Q N V Y I V D | G V R T P V G K F G | G | A Y K D I P A V D | L A S F T L K E V L | | | | | | | | | | |

| | | 151 | | | 161 | | | 171 | | | 181 | | | 191 | | | |
|---|---|---|---|---|---|---|---|---|---|---|---|---|---|---|---|---|---|
| Conservation | | * | * | * | * | * | * | * | * | * | * | * | * | * | * | * | * |
| 640506560.Msed_0656 | 139 | K S L N F | I D T M L | V D G L T D P | F N L | K L M G Q | E A D M V | A R E R D I S R R E | L D E V A F E S | H R |
| 638192756.ST0514 | 141 | K K L D F | I D T M L | I D G L T D P | F N M | K L M G Q | E A D M V | A K S H N N I S R K E | L D E V A Y E S | H K |
| 650770713.TUZN_0403 | 139 | R G Q Q L | L D L M V | Y D G L T D P | F T N G | L L M G Q | E A E M V | A K E W G I T R Q E | L D Q V A Y E Q S | H M |
| 650821827.Mcup_1437 | 139 | K S L S F | I D T M L | Q D G L T D P | F F Q Y | K V M G Q | E A D M V | A K E R D I S R K E | L D E I A L E S | H L |
| 646942850.Ssol_0188 | 140 | R N I E L | I D T M L | Y D G L T D P | F F L Q | K V M G Q | E A D M V | A K S H N N I S R K E | L D E V A Y Q S | H L |
| 650841420.YN1551_2779 | 147 | R S I E L | I D T M L | Y D G L T D P | F F N M | K V M G Q | E A D M V | A K A H N N F T R Q E | L D E V A Y Q S | H L |
| 650848421.Ahos_2176 | 139 | K Q L E F | V D T M L | M D G L T D P | F A T G | K L M G E | E A D M V | A K E H K K I A R E E | L D K V A Y E S | H M |
| 641667412.Tneu_0249 | 138 | R R F E L | T D L M V | F D G L T D P | F F L Q | M V M G E | E A D M V | A K A H H N I S R K E | L D D V A Y Q S | H L |
| 638197890.Saci_0963 | 139 | K S L D I | I D T M L | I D G L T D P | F F L L | K V M G Q | E A D M V | A K E H E I T R R E | L D E V A Y E S | H L |
| 650472007.SiRe_0173 | 147 | R N I E L | I D T M L | Y D G L T D P | F F L Q | K V M G Q | E A D M V | A K A H N N I S R K E | L D E V A Y Q S | H L |
| 643836114.YG5714_0177 | 147 | R S I E L | I D T M L | Y D G L T D P | F F L Q | K V M G Q | E A D M V | A K A H N N I S R K E | L D E V A Y Q S | H L |
| 643842011.M1627_0173 | 147 | R S I E L | I D T M L | Y D G L T D P | F P S N | K V M G Q | E A D M V | A R E H K K I T R Q E | L D E V A Y Q S | H M |
| 650474766.SIH_0179 | 147 | R S I E L | I D T M L | Y D G L T D P | F V N G | L L M G E | E A E L V | A R E H K K I T R Q E | L D W V A Y E S | H L |
| 643830761.LS215_0204 | 147 | R R A E L | R D L M V | Y D G L T D P | P V N G | K V M G Q | E A E M V | A K E W G L T R Q E | L D L V A Y E Q S | H L |
| 640124530.Peal_0781 | 138 | R G Q Q L | L D L M V | Y D G L T D P | P V N G | K V M G Q | V E A D M T | A K K Y G A K R R E | L D W I A Y Q S | H M |
| 640467886.Pars_0309 | 151 | R E A K L | L I D T M L | L D G L T D P | S W N W | O L L M G E | E E A D M V | A K E W G L T R Q E | L D E V A Y E S | H M |
| 643882805.M164_0192 | 147 | R S I E L | I D T M L | Y D G L T D P | P V N G | L K W M G Q | E E A D M V | A K A H N N I S R K E | L D E V A Y Q S | H M |
| 640897989.igni_1401 | 139 | R E A K L | I D T M V | L D G L T D P | F L Q | K V M G Q | E A D M V | A K A H N N I S R K E | L D E V A Y Q S | H L |
| 2512379618.Pogu_2093 | 151 | R G Q Q L | L D L M V | Y D G L T D P | P V N F | L L M G E | E A E M V | A K E W G L T R Q E | L D W I A Y E S | H R |
| 646526983.LD85_0177 | 147 | R S I E L | I D T M L | Y D G L T D P | F F L Q | K V M G Q | E A D M V | A K A H N N I S R K E | L D E V A Y Q S | H L |
| 643828073.M1425_0173 | 147 | R N I E L | I D T M L | Y D G L T D P | F F N L | K L M G Q | E A D M V | A R E H E I T R R E | L D E V A Y E S | H R |
| 2524414169.SachN8_04675 | 139 | K S L D I | I D T M I | I D G L T D P | F F N L | M L M G E | E T D L L | A R E H E I T R R E | L D E V A Y E S | H R |
| 2508722819.Met...lDRAFT_00011710 | 139 | R N V E F | L L D T M L | F D G L T D P | F T N Q | M L M G E | E T D L L | A R E W G I T R Q E | L D Q V A Y E S | H M |
| 2511627177.TTX_0886 | 139 | R Q Q A L | V D L M V | Y D G L T D P | F N Q Y | K L M G Q | E A D M V | A K S H N I S R K E | L D E V A Y Q S | H L |
| 650243136.Ssol198_01010003733 | 140 | R N I E L | I D T M L | Y D G L T D P | F F Q Y | K V M G Q | E A D M V | A K S H N I S R K E | L D E V A Y Q S | H L |
| 638163597.SSO2377 | 140 | R N I E L | I D T M L | Y D G L W D | V L L N | K V M G E | E A D M T | A E Y N A P R D E | L D R I S Y E S | H E |
| 648117228.ASAC_0321 | 143 | R E W Q I | L D A M V | Y D G L T D P | F F Q Y | K V M G E | E A D M T | | | |

| | | 251 | | 261 | | 271 | | 281 | | 291 | |
|---|---|---|---|---|---|---|---|---|---|---|---|
| Conservation | | * | * | * | * | | | | | | |
| 640506560.Msed_0656 | 235 | F T E N G Y H T A G | N S S Q Q I S D D G A V | A M V L M S E K A V | K E F G V D P V A K | I L G Y S W V G I E |
| 638192756.STD514 | 237 | F S P D G V H T A G | N S S Q Q I S D G S S | A L V I V S E K I V | K E Y K L K P I A K | I L G Y S W V G I E |
| 650770713.TUZN_0403 | 238 | F R P D D G V L T A G | N S S Q Q I S D D G A A | A L V L A S S D K A | K E L G L K P V A K | I L G Y S W H M V |
| 650821827.Mcup_1437 | 235 | F T E N G V H T A G | N S S Q Q I S D D G A T | A L V L M S E K K A | K E Y G V K P V A R | I M G Y S W V G I E |
| 646942850.Ssol_0188 | 236 | F T D D G L H T A G | N S S Q Q I S D D G A T | A L V L V S E K A A | K E L K I E P I A R | I L G Y S W V G I E |
| 643841420.YN1551_2779 | 243 | F T D G G P H T A G | N S S Q Q I S D D G A T | A L V L M S E K A V | K E L K I E P I A R | V L G F S W A G I E |
| 650848421.Ahos_2176 | 235 | F S K D G L H T A G | N S S Q Q I S D D G A A | A L V L M S E K A V | K E F G V D P L A R | V L G G Y S W H M L |
| 641667412.Tneu_0249 | 235 | F K P D D G L H T A G | N S S Q Q L S D D G A A | A L V L F V S E S A V | R R K F K L E P I A R | V L G Y S W I G I E |
| 638197890.Saci_0963 | 243 | F T D G G L H T A G | N S S Q Q I S D D G A T | A L V L M S E K A A | K E L K I E P I A R | I L G Y S W V G I E |
| 650472007.SiRe_0173 | 243 | F T D G G P H T A G | N S S Q Q I S D D G A T | A L V L M S E K A A | K E L K I E P I A R | I L G Y S W V G I E |
| 643836114.YG5714_0177 | 243 | F T D G G P H T A G | N S S Q Q I S D D G A T | A L V L M S E K A A | K E L K I E P I A R | I L G Y S W V G I E |
| 643842011.M1627_0173 | 243 | F T D G G P H T A G | N S S Q Q I S D D G A T | A L V L M S E K A A | K E L K I E P I A R | I L G Y S W V G I E |
| 650474766.SiH_0179 | 243 | F T D G G P H T A G | N S S Q Q I S D D G A T | A L V L M S E K A A | K E L S L R P V A R | V L G Y S W H M V E |
| 643830761.LS215_0204 | 243 | F T D G G P H T A G | N S S Q Q I S D D G A T | V L V L M S E K A I | K E L K I E P I A R | I L G Y S W V G I E |
| 640124530.Pcal_0781 | 237 | F R P D G L H T A G | N S S Q Q L S D D G A A | A L L L T T E E A D K A | N E Y G L K P V A K | V L A Y D I V G L K |
| 640467886.Pars_0309 | 250 | F K P D D G V L T A G | N S S Q Q I S D D G A T | A L I M A P E E V V | K E L K I E P I A R | V L G Y S W H M V E |
| 643882305.M164_0192 | 243 | F T D G G P H T A G | N S S Q Q I S D D G A T | V L V L A A S A D K A | K E L K I E P I A R | I L G Y S W V G I E |
| 640897989.Igni_1401 | 239 | F T P D G V H T A G | N S S Q Q I S D D G A T | A L I M A P E E A D K A | N E Y G L K P V A K | V L A Y D I V G L K |
| 2512379618.Pogu_2093 | 250 | F K P D D G V L T A G | N S S Q Q I S D D G A T | A L V L A A S A D K A | K E L K I E P I A R | I L G Y S W V G I E |
| 646526983.LD85_0177 | 243 | F T D C G P H T A G | N S S Q Q I S D D G A T | A L V L M S E K A A | K E L K I E P I A R | I L G Y S W V G I E |
| 643828073.M1425_0173 | 243 | F T D C G P H T A G | N S S Q Q I S D D G A T | A L V F V S E S A V | K E L K I E P I A R | V L G Y S W I G I E |
| 2524414169.SacN8_04675 | 235 | F G S D G L H T A G | N S S Q Q I S D D G A A | A L V L M S E K A V | R K F K L E P I A R | I M G H S W V G I E |
| 2508722819.Met...1DRAFT_00011710 | 235 | F S F R P D G L H T A G | N S S Q Q L S D D G A A | A L V L A S A E R A | R E R R I E P I A R | I L G Y S W H M V E |
| 2511627177.TTX_0886 | 238 | F R P D D G L H T A G | N S S Q Q I S D D G A A | A L V L V S E K A A V | K E L K I E P I A R | I L G Y S W V G I E |
| 650024136.Ssol98_01010003733 | 236 | F T D D D G L H T A G | N S S Q Q I S D D G A A | V L V L A S A E R A | K E L G I E P V A K | V L G Y S W H M V E |
| 638163597.SSO2377 | 236 | F T D D G L H T A G | N S S Q Q I S D D G A A | A L V L V S E K A A A | K E L K I E P I A R | I L G Y S W V G I E |
| 648117228.ASAC_0321 | 240 | F T S R G P H T A G | S S S Q L S D D G A A | T L L I I A S E E A V | K S L G L K P I A R | I V G F A Y H G V E |

| | | 351 | | | | 361 | | | | 371 | | | | 381 | | | | 391 | | | |
|---|---|---|---|---|---|---|---|---|---|---|---|---|---|---|---|---|---|---|---|---|---|
| Conservation | | . . | . | . | * | * | * | * | . . | * | * | . . | * | * | . | . | * | * | * | * | . |
| 640506560.Msed_0656 | | 335 | D Q L N V F G G A I | A L G H P I G A S G | A R I M V T L L N V | L S K M N A T R G I | A S I C H G V G G S |
| 638192756.ST0514 | | 337 | D R L N V F G G A I | A L G H P I G A S G | A R I I I T L L N V | L S T M G G K R R G I | A S I C H G T G G S |
| 650770713.TUZN_0403 | | 338 | E R L N V F G G A V | A L G H P L G A S G | A R I I I T L L N V | L K V K G G R R R G I | A A L C H G T G G S |
| 650821827.Mcup_1437 | | 335 | E K L N V F G G A I | A I G H P I G A S G | A R I I I V T L L N V | L S K M Q G K R R G I | A S I C H G T G G S |
| 646942850.Ssol_0188 | | 336 | D R L N V F G G A I | A L G H P I G A S G | A R I I V T L L N V | L S K M H G T R G I | A S I C H G I G G S |
| 643841420.YN1551_2779 | | 343 | D R L N V F G G A I | A L G H P I G A S G | A R I I V T L L N V | L S K M R G A R G I | A S I C H G T G G S |
| 650848421.Abos_2176 | | 335 | D R L N V F G G A I | A L G H P I G A S G | A R I I V T L L N V | L S K M K G E R G I | A S I C H G I G G S |
| 641667412.Tneu_0249 | | 335 | D R M N V F G G A I | A L G H P I G A S G | T R I L I S V | L R R M G G R R G V | A S I C H G I G G S |
| 638197890.Saci_0963 | | 335 | D R L N V Y G G A I | A L G H P I G A S G | S R I I I T L L N V | L S K M N G K Y G I | A S I C H G I G G S |
| 650472007.SiRe_0173 | | 343 | D R L N V F G G A I | A L G H P I G A S G | A R I I I V T L L N V | L S K M R G A R G I | A S I C H G I G G S |
| 643836114.YG5714_0177 | | 343 | D R L N V F G G A I | A L G H P I G A S G | A R I I V T L L N V | L S K M R G A R G I | A S I C H G I G G S |
| 643842011.M1627_0173 | | 343 | D R L N V F G G A I | A L G H P I G A S G | A R I I V T L L N V | L S K M R G A R G I | A A L C H G I G G S |
| 650474766.SIH_0179 | | 343 | D K L N V F G G A I | A L G H P I G A S G | A R I I V T L L N V | L S K M R G A R G I | A T L C H G I G G S |
| 643830761.LS215_0204 | | 337 | D K L N V F G G A I | A L G H P I G A S G | A R I I V V T L L N A | L K T H N K S R G V | A A L C H G I G G S |
| 640124530.Pcal_0781 | | 350 | D K L N V F G G A I | A I G H P I G A S G | A R I I V T T L L S V | L K V V K G G R R G I | A S I C H G T G G S |
| 640467886.Pars_0309 | | 343 | D R L N V F G G A I | A L G H P I G A S G | A R I I V T L L N V | L S K M R G A R G I | A A L C H G I G G S |
| 643882805.M164_0192 | | 343 | D R L N V F G G A I | A L G H P L G A S G | A R I I V T T L L N V | L R R M G G R R G I | A S I C H G T G G S |
| 640897989.Igni_1401 | | 339 | E R M N V H G G A I | A F G H P I G A S G | A R I V T L L N V | L K V V K G G R R G I | A A L C H G T G G S |
| 2512379618.Pogu_2093 | | 350 | D K L N V F G G A I | A L G H P I G A S G | A R I I I V T T L L N V | L S K M R G A R G I | A A L C H G I G G S |
| 646526983.LD85_0177 | | 343 | D R L N V F G G A I | A L G H P L G A S G | A R I I V T L L N V | L S K M R G A R G I | A S I C H G I G G S |
| 643828073.M1425_0173 | | 343 | D R L N V Y G G A I | A L G H P I G A S G | S R I I V T L L N V | L R K M N G K Y G I | A A L C H G I G G S |
| 2524414169.SacN8_04675 | | 335 | D R L N V F G G A I | A L G H P I G A S G | A R I I V T T L L S V | L R R M K G E R G I | A S I C H G T G G S |
| 2508722819.Met...IDRAFT_00011710 | 335 | E R L N V F G G A I | A L G H P I G A S G | A R I I V T L L N V | L S R M K G E R G I | A A L C H G I G G S |
| 2511627177.TTX_0886 | | 338 | E K L N V P F G G A I | A L G H P I G A S G | A R V I V T L L N V | L K V K G A K R G I | A S I C H G T G G S |
| 650024136.Ssol98_01010000373 | 336 | D R L N V F G G A I | A L G H P I G A S G | A R I I I V T L L S V | L R R H G G K R G I | A S I C H G I G G S |
| 638163597.SSO2377 | | 336 | D R L N V F G G A I | A L G H P I G M S G | A R I T L E L I N V | L S K M H G T R G I | A S I C H G I G G S |
| 648117228.ASAC_0321 | | 340 | D R M N V H G G A I | A V G H P L G M S G | A R I T L E L I N V | L R R H G G K R G V | A S I C H G L G G A |

Fig. 62-9

| | | 401 | | | | | | | | | | | | | | 411 | | |
|---|---|---|---|---|---|---|---|---|---|---|---|---|---|---|---|---|---|---|
| Conservation | | . | . | . | * | . | . | . | . | . | . | . | . | . | . | . | . | |
| 640506560.Msed_0656 | 385 | T | A | I | A | L | E | L | L | R | P | L | - |
| 638192756.ST0514 | 387 | T | A | I | A | I | E | L | L | R | P | L | - |
| 650770713.TUZN_0403 | 388 | T | A | V | A | L | E | I | L | - | - | - | I | G |
| 650921827.Mcup_1437 | 385 | T | A | V | E | L | M | R | P | M | K |
| 646942850.Ssol_0188 | 386 | T | A | I | A | I | E | L | L | K | E | M | K |
| 643841420.YN1551_2779 | 393 | T | A | V | A | I | E | L | L | R | P | L | - |
| 650848421.Ahos_2176 | 385 | T | A | M | A | I | E | L | L | R | P | - | - |
| 641667412.Tneu_0249 | 385 | T | A | V | A | L | E | L | L | I | - | - | - |
| 638197890.Saci_0963 | 385 | T | A | V | A | I | E | L | L | R | E | M | K |
| 650472007.SiRe_0173 | 393 | T | A | V | A | I | E | L | L | R | E | M | K |
| 643836114.YG5714_0177 | 393 | T | A | V | A | I | E | L | L | R | E | M | K |
| 643842011.M1627_0173 | 393 | T | A | V | A | I | E | L | L | R | E | M | K |
| 650474766.SiH_0179 | 393 | T | A | V | A | I | E | L | L | R | E | M | K |
| 643830761.LS215_0204 | 393 | T | A | V | A | I | E | L | L | R | E | M | K |
| 640124530.Peal_0781 | 387 | T | A | L | A | L | A | V | E | L | V | - | - |
| 640467886.Pars_0309 | 400 | T | A | L | A | V | E | L | L | R | E | M | K |
| 643882805.M164_0192 | 393 | T | A | V | A | I | E | L | L | R | E | - | - |
| 640897989.Igni_1401 | 389 | S | T | L | A | I | E | V | F | - | - | - | - |
| 2512379618.Pogu_2093 | 400 | T | A | L | A | V | E | L | L | R | E | M | K |
| 646526983.LD85_0177 | 393 | T | A | V | A | I | E | L | L | R | E | M | K |
| 643828073.M1425_0173 | 393 | T | A | V | A | I | E | L | L | R | E | - | - |
| 252414169.SacN8_04675 | 385 | T | A | I | A | V | E | L | L | - | - | L | P |
| 250872238195.Met...1DRAFT_00011710 | 385 | T | A | I | G | I | E | L | I | K | P | - | - |
| 2511627177.TTX_0886 | 388 | T | A | I | A | I | E | L | A | - | - | M | K |
| 650024136.Ssol98_01010000003733 | 386 | T | A | I | A | I | E | L | L | K | E | M | K |
| 638163597.SSO2377 | 386 | T | A | I | A | I | E | L | L | K | E | - | - |
| 648117228.ASAC_0321 | 390 | A | S | I | A | I | E | L | V | - | - | - | - |

SEQUESTRATION OF CARBON DIOXIDE WITH HYDROGEN TO USEFUL PRODUCTS

CROSS-REFERENCE TO RELATED APPLICATIONS

This application is the §371 U.S. National Stage of International Application No. PCT/US13/58593, filed Sep. 6, 2013, which claims the benefit of U.S. Provisional Application Ser. No. 61/697,654, filed Sep. 6, 2012, each of which are incorporated by reference herein in their entireties.

SEQUENCE LISTING

This application contains a Sequence Listing electronically submitted via EFS-Web to the United States Patent and Trademark Office as an ASCII text file entitled "235_01670101_SequenceList_ST25.txt" having a size of 1,255 kilobytes and created on Dec. 12, 2016. The information contained in the Sequence Listing is incorporated by reference herein.

GOVERNMENT FUNDING

The present invention was made with government support under Grant No. DE-AR0000081, awarded by the Department of Energy. The government has certain rights in this invention.

BACKGROUND

Carbon dioxide is chemically stable and unreactive, and must be reduced to enable its incorporation into biological molecules. Autotrophic microorganisms are able to utilize carbon dioxide as their sole carbon source and a variety of pathways are known to activate and incorporate it into biomolecules essential for growth and replication. Recently, carbon dioxide fixation pathways have received interest for biotechnological applications, since this could provide biological routes for de novo generation of fuels and small organic molecules (Hawkins et al., 2011, *ACS Catal.* 1, 1043-1050).

There are currently at least six natural pathways for the incorporation of inorganic carbon dioxide into cellular carbon (Berg 2011, *Appl. Environ. Microbiol.* 77, 1925-1936; Berg et al., 2010, *Nat. Rev. Microbiol.* 8, 447-460). The most recently discovered of these are found exclusively in extremely thermophilic archaea: the 3-hydroxypropionate/4-hydroxybutyrate (3HP/4HB) carbon fixation cycle, which operates in members of the crenarchaeal order Sulfolobales ((Berg 2011, *Appl. Environ. Microbiol.* 77, 1925-1936; Berg et al., 2007, *Science* 318, 1782-1786; Alber et al., 2008, *J. Bacteriol.* 190, 1383-1389; Hugler et al., (2003) *Arch. Microbiol.* 179, 160-173), and the dicarboxylate/4-hydroxybutyrate (DC/4HB) cycle, which is used by anaerobic members of the orders Thermoproteales and Desulfurococcales (Berg et al., 2007, *Science* 318, 1782-1786; Huber et al., (2008) *PNAS USA* 105, 7851-7856). In both cycles, two carbon dioxide molecules are added to acetyl-CoA (C2) to produce succinyl-CoA (C4), which is subsequently rearranged to acetoacetyl-CoA and cleaved into two molecules of acetyl-CoA. These pathways differ primarily in regards to their tolerance to oxygen and the co-factors used for reducing equivalents—NAD(P)H for the 3HP/4HB cycle and ferredoxin/NAD(P)H for the DC/4HB cycle (Berg et al., 2010, *Nat. Rev. Microbiol.* 8, 447-460; Auernik and Kelly, 2010, *Appl. Environ. Microbiol.* 76, 931-935). The two archaeal pathways also differ in how they link the $CO_2$ fixation cycle to central metabolism. In the DC/4HB pathway, pyruvate is synthesized directly from acetyl-CoA using pyruvate synthase. In the 3HP/4HB pathway, another half-turn is required to make succinyl-CoA, which is then oxidized via succinate to pyruvate (Berg 2011, *Appl. Environ. Microbiol.* 77, 1925-1936; Ramos-Vera et. al., 2011, *J. Bacteriol.* 193, 1201-1211; Estelmann et al., (2011) *J. Bacteriol.* 193, 1191-1200).

There are 13 enzymes proposed to catalyze the 16 reactions in the 3HP/4HB pathway. The first three enzymes convert acetyl-CoA (C2) to 3HP (C3) via an ATP-dependent carboxylation step. Next, 3HP is converted and reduced to propionyl-CoA, carboxylated a second time and rearranged to make succinyl-CoA (C4). Succinyl-CoA is reduced to 4HB, which is converted to two molecules of acetyl-CoA in the final reactions of the cycle. Flux analysis and labeling studies have confirmed the operation of this pathway in *M. sedula* (Berg et al., 2007, *Science* 318, 1782-1786; Estelmann et al., (2011) *J. Bacteriol.* 193, 1191-1200).

SUMMARY OF THE INVENTION

Enzymes of the first portion of the 3-hydroxypropionate/4-hydroxybutyrate carbon fixation cycle up to the formation of 4-hydroxybutyrate (4HB) have been identified and characterized biochemically in their native or recombinant form, mostly from the extremely thermoacidophilic archaeon *Metallosphaera sedula* (T=70° C., pH=2.0) (See Table 1). The enzymes involved in the conversion of 4HB to two molecules of acetyl-CoA have not been characterized to the same extent (FIG. 1, E10-E13). Activities corresponding to 4-hydroxybutyryl-CoA dehydratase and acetoacetyl-CoA β-ketothiolase have been detected in cell extracts, although neither enzyme has been purified in its native form or recombinantly produced. Identification of candidates for both of these enzymes has been made based on genome annotation and transcriptomic analysis of autotrophic growth compared to heterotrophy (Auernik and Kelly, 2010, *Appl. Environ. Microbiol.* 76, 931-935; Ramos-Vera et. al., 2011, *J. Bacteriol.* 193, 1201-1211). While neither of the candidate genes for these enzymes has so far been confirmed biochemically, their identity is not in dispute because of strong homology to known versions in less thermophilic organisms. The corresponding gene products in *M. sedula* are Msed_1321 for the 4HB-CoA dehydratase and Msed_0656 for the acetoacetyl-CoA β-ketothiolase. Further, the polypeptides of the 3-hydroxypropionate/4-hydroxybutyrate carbon fixation cycle have not been genetically engineered for expression in any system that allows one to take advantage of the stability of the polypeptides at high temperatures.

TABLE 1

Enzymes in the 3HP/4HB Cycle in *Metallosphaera sedula*

| Enzyme Reference # | ORF | Enzyme | Lit. Ref. |
|---|---|---|---|
| E1α | Msed_0147 | acetyl-CoA/propionyl-CoA carboxylase | NCE (1, 2) |
| E1β | Msed_0148 | | |
| E1γ | Msed_1375 | | |
| E2 | Msed_0709 | malonyl-CoA/succinyl-CoA reductase | R (3) |
| E3 | Msed_1993 | malonate semialdehyde reductase | R (3) |

TABLE 1-continued

Enzymes in the 3HP/4HB Cycle in *Metallosphaera sedula*

| Enzyme Reference # | ORF | Enzyme | Lit. Ref. |
|---|---|---|---|
| E4 | Msed_1456 | 3-hydroxypropionate: CoA ligase | NP (5) |
| E5 | Msed_2001 | 3-hydroxypropionyl-CoA dehydratase | NP, R (4) |
| E6 | Msed_1426 | acryloyl-CoA reductase | NP (4) |
| E7 | Msed_0639 | methylmalonyl-CoA epimerase | R (6) |
| E8α E8β | Msed_0638 Msed_2055 | methylmalonyl-CoA mutase | R (6) |
| E9 | Msed_1424 | succinate semialdehyde reductase | NP, R (3) |
| E10 | Msed_0394 Msed_0406 | 4-hydroxybutyrate: CoA ligase | R, Example 1 |
| E11 | Msed_1321 | 4-hydroxybutyrl-CoA dehydratase | NCE (7) R, Example 8 |
| E12 | Msed_0399 | crotonyl-CoA hydratase/(S)-3-hydroxybutyrl-CoA dehydrogenase | R (8) |
| E13 | Msed_0656 | acetoacetyl-CoA β-ketothiolase | NCE (7); R, Example 8 |

1, Hügler et al., 2003, *Eur. J. Biochem.* 270, 736-744; 2, Menendez et al., 1999 *J. Bacteriol.* 181, 1088-1098; 3, Kockelkorn and Fuchs, 2009, *J. Bacteriol.* 191, 6352-6362; 4, Teufel et al., 2009, *J. Bacteriol.* 191, 4572-4581; 5, Alber et al., 2008, *J. Bacteriol.* 190, 1383-1389; 6, Han et al., 2012, *Appl. Environ. Microbiol.* 78:6194-62027; 7, Berg et al., 2007, *Science* 318, 1782-1786; and 8, Ramos-Vera et. al., 2011, *J. Bacteriol.* 193, 1201-1211.

The identity of the crotonyl-CoA hydratase and the (S)-3-hydroxybutyryl-CoA dehydrogenase was recently confirmed, when it was discovered that both reactions were catalyzed by a single bifunctional fusion protein (Ramos-Vera et. al., 2011, *J. Bacteriol.* 193, 1201-1211). In the same work, Ramos-Vera et al. tested three different candidates for the 4HB-CoA synthetase, but all failed to show activity on 4HB. In fact, the primary candidate suggested by the autotrophic transcriptome analysis (Msed_1422) showed no enzymatic activity on short-chain linear unsubstituted or hydroxy-acids—specifically acetate, propionate, 3HP, 3-hydroxybutyrate, 4HB and crotonate. Two other candidates were selected, based on homology to 4HB-CoA synthetase from *T. neutrophilus* (Tneu_0420) and 3HP-CoA synthetase from *M. sedula*: Msed_1353 and Msed_1291 were recombinantly produced and tested for ligase activity. Msed_1353 was active on propionate and acetate, but not on 4HB. Furthermore, Msed_1291 had no activity on any of the previously mentioned organic acids. Thus, although cycle function has been confirmed by metabolic flux analysis, and while 4HB-CoA synthetase activity has been measured in cell extracts of autotrophically-grown *M. sedula*, the enzyme responsible for ligation of CoA to 4HB remains unclear.

In order to identify the missing link in the 3HP/4HB cycle, new methods for semi-continuous cultivation of *M. sedula* in a gas-intensive fermentation system were developed to tease out differential transcriptional response of autotrophy-related genes. Strict carbon dioxide limitation was used to drive increased operational efficiency of the $CO_2$ fixation enzymes, which hypothetically would increase transcriptional levels of genes encoding key enzymes to maximize carbon incorporation. Using these conditions for transcriptional analysis, a much clearer picture emerged concerning the global regulatory changes in *M. sedula*, as its cellular metabolism switches from autotrophy to heterotrophy. This strategy produced new leads for the genes and corresponding enzymes responsible for the 4HB-CoA ligation step. The enzymes were recombinantly produced and shown to catalyze the ligation of CoA to 4HB.

Accordingly, provided herein are genetically engineered microbes. In one embodiment, the genetically engineered microbe is modified to convert acetyl CoA, molecular hydrogen, and carbon dioxide to 3-hydroxypropionate. The 3-hydroxypropionate is produced at increased levels compared to a control microbe. In one embodiment, the genetically engineered microbe that includes (a) enzymes to fix $CO_2$ and produce 3-hydroxypropionate and (b) an NADPH-dependent hydrogenase. The genetically engineered microbe has greater production of 3-hydroxypropionate than a control microbe that does not include either (a) or (b). The 3-hydroxypropionate may be produced in the absence of light energy.

In one embodiment, the genetically engineered microbe includes an exogenous coding region encoding a polypeptide, wherein the polypeptide has an activity selected from acetyl/propionyl-CoA carboxylase activity, malonyl/succinyl-CoA reductase activity, and malonate semialdehyde reductase activity. In one embodiment, the genetically engineered microbe includes an exogenous coding region encoding a polypeptide having acetyl/propionyl-CoA carboxylase activity, an exogenous coding region encoding a polypeptide having malonyl/succinyl-CoA reductase activity, and an exogenous coding region encoding a polypeptide having malonate semialdehyde reductase activity.

In one embodiment, the genetically engineered microbe is modified to convert acetyl CoA, molecular hydrogen and carbon dioxide to 4-hydroxybutyrate. The 4-hydroxybutyrate is produced at increased levels compared to a control microbe. In one embodiment, the genetically engineered microbe includes (a) enzymes to fix $CO_2$ and produce 4-hydroxybutyrate and (b) an NADPH-dependent hydrogenase. The genetically engineered microbe has greater production of 3-hydroxypropionate than a control microbe that does not include either (a) or (b). The 4-hydroxybutyrate may be produced in the absence of light energy.

In one embodiment, the genetically engineered microbe produces 3-hydroxypropionate, and the microbe includes an exogenous coding region encoding a polypeptide, wherein the polypeptide has an activity selected from 3-hydroxypropionate:CoA ligase activity, 3-hydroxypropionyl-CoA dehydratase activity, acryloyl-CoA reductase activity, methylmalonyl-CoA epimerase activity, methylmalonyl-CoA mutase activity, and succinate semialdehyde reductase activity. In one embodiment, the genetically engineered microbe produces 3-hydroxypropionate, and the microbe includes an exogenous coding region encoding a polypeptide having 3-hydroxypropionate:CoA ligase activity, an exogenous coding region encoding a polypeptide having 3-hydroxypropionyl-CoA dehydratase activity, an exogenous coding region encoding a polypeptide having acryloyl-CoA reductase activity, an exogenous coding region encoding a polypeptide having methylmalonyl-CoA epimerase activity, an exogenous coding region encoding a polypeptide having methylmalonyl-CoA mutase activity, and an exogenous coding region encoding a polypeptide having succinate semialdehyde reductase activity.

In one embodiment, the genetically engineered microbe is modified to produce acetyl CoA at increased levels compared to a control microbe. In one embodiment, the genetically engineered microbe is modified to consume one acetyl CoA molecule, molecular hydrogen and carbon dioxide to produce two acetyl CoA molecules at increased levels compared to a control microbe. The acetyl CoA may be produced in the absence of light energy.

In one embodiment, the genetically engineered microbe produces 4-hydroxybutyrate, and the microbe includes an exogenous coding region encoding a polypeptide, wherein the polypeptide has an activity selected from 4-hydroxybutyrate:CoA ligase activity, 4-hydroxybutyrl-CoA dehydratase activity, crotonyl-CoA hydratase/(S)-3-hydroxybutyrl-CoA dehydrogenase activity, and acetoacetyl-CoA β-ketothiolase activity. In one embodiment, the genetically engineered microbe produces 4-hydroxybutyrate, and the microbe includes an exogenous coding region encoding a polypeptide having 4-hydroxybutyrate:CoA ligase activity, an exogenous coding region encoding a polypeptide having 4-hydroxybutyrl-CoA dehydratase activity, an exogenous coding region encoding a polypeptide having crotonyl-CoA hydratase/(S)-3-hydroxybutyrl-CoA dehydrogenase activity, and an exogenous coding region encoding a polypeptide having acetoacetyl-CoA β-ketothiolase activity.

In one embodiment, the genetically engineered microbe is an extremophile, such as a hyperthermophile. In one embodiment, the hyperthermophile is an archeon. In one embodiment, the archeon is a member of the Order Thermococcales, a member of the Order Sulfolobales, or a member of the Order Thermotogales. In one embodiment, the archeon is *Thermococcus kodakarensis, T. onnurineus, Sulfolobus solfataricus, S. islandicus, S. acidocaldarius*, or *Pyrococcus furiosus*.

In one embodiment, an exogenous coding region is operably linked to a temperature sensitive promoter, to a constitutive promoter, or to a non-regulated promoter. In one embodiment, the genetically engineered microbe further includes a hydrogenase, such as a NADPH-dependent hydrogenase. In one embodiment, the genetically engineered microbe includes exogenous coding regions encoding subunits of the NADPH-dependent hydrogenase. In one embodiment, the subunits of the NADPH-dependent hydrogenase include a hydrogenase alpha subunit and a hydrogenase delta subunit. In one embodiment, the subunits of the NADPH-dependent hydrogenase further include a hydrogenase beta subunit and a hydrogenase gamma subunit.

Also provided herein are methods for using the genetically engineered microbes. In one embodiment, the method includes incubating the genetically engineered microbe under anaerobic conditions suitable for converting acetyl CoA, molecular hydrogen, and carbon dioxide to 3-hydroxypropionate, to 4-hydroxybutyrate, acetyl CoA, or a combination thereof. In one embodiment, the method further includes converting the 3-hydroxypropionate, 4-hydroxybutyrate, or acetyl CoA into another product, such as pyruvate or succinate. In one embodiment, the method further includes recovering the 3-hydroxypropionate, 4-hydroxybutyrate, acetyl CoA or other product.

Also provided herein are cell free compositions. In one embodiment, the cell free composition converts acetyl CoA, molecular hydrogen and carbon dioxide to 3-hydroxypropionate. The cell free composition includes a polypeptide having acetyl/propionyl-CoA carboxylase activity, a polypeptide having malonyl/succinyl-CoA reductase activity, a polypeptide having malonate semialdehyde reductase activity, and a polypeptide having NADPH-dependent hydrogenase activity. In one embodiment, the cell free composition converts 3 hydroxypropionate to 4-hydroxybutyrate. In such an embodiment, the composition further includes a polypeptide having 3-hydroxypropionate:CoA ligase activity, a polypeptide having 3-hydroxypropionyl-CoA dehydratase activity, a polypeptide having acryloyl-CoA reductase activity, a polypeptide having methylmalonyl-CoA epimerase activity, a polypeptide having methylmalonyl-CoA mutase activity, and a polypeptide having succinate semialdehyde reductase activity. In one embodiment, the cell free composition converts 4-hydroxybutyrate to acetyl CoA. In such an embodiment, the composition further includes a polypeptide having 4-hydroxybutyrate:CoA ligase activity, a polypeptide having 4-hydroxybutyrl-CoA dehydratase activity, a polypeptide having crotonyl-CoA hydratase/(S)-3-hydroxybutyrl-CoA dehydrogenase activity, and a polypeptide having acetoacetyl-CoA β-ketothiolase activity.

Also provided herein are methods for using a cell free composition. In one embodiment, the cell free method fixes $CO_2$, and includes incubating the cell free composition under anaerobic conditions suitable for the fixation of $CO_2$ by the conversion of acetyl CoA, molecular hydrogen and carbon dioxide to 3-hydroxypropionate. In one embodiment, the method further includes isolating the 3-hydroxypropionate. In one embodiment, the cell free method fixes $CO_2$, and includes incubating the cell free composition under anaerobic conditions suitable for the fixation of $CO_2$ by the conversion of acetyl CoA, molecular hydrogen and carbon dioxide to 4-hydroxybutyrate. In one embodiment, the method further includes isolating the 4-hydroxybutyrate. In one embodiment, the method fixes $CO_2$ and includes incubating the cell free composition under anaerobic conditions suitable for the fixation of $CO_2$ by the conversion of 4-hydroxybutyrate, molecular hydrogen and carbon dioxide to acetyl CoA. In one embodiment, the method further includes isolating the acetyl CoA. In one embodiment, the conditions include a temperature between 60° C. and 80° C.

As used herein, the term "polypeptide" refers broadly to a polymer of two or more amino acids joined together by peptide bonds. The term "polypeptide" also includes molecules which contain more than one polypeptide joined by a disulfide bond, ionic bonds, or hydrophobic interactions, or complexes of polypeptides that are joined together, covalently or noncovalently, as multimers (e.g., dimers, trimers, tetramers). A polypeptide also may possess non-protein (non-amino acid) ligands including, but not limited to, inorganic iron (Fe), nickel (Ni), inorganic iron-sulfur centers such as [4Fe-4S] clusters, and other organic ligands such as carbon monoxide (CO), cyanide (CN) and flavin. Thus, the terms peptide, oligopeptide, enzyme, subunit, and protein are all included within the definition of polypeptide and these terms are used interchangeably. It should be understood that these terms do not connote a specific length of a polymer of amino acids, nor are they intended to imply or distinguish whether the polypeptide is produced using recombinant techniques, chemical or enzymatic synthesis, or is naturally occurring.

As used herein, "heterologous amino acid sequence" refers to amino acid sequences that are not normally present as part of a polypeptide present in a wild-type cell. For instance, "heterologous amino acid sequence" includes extra amino acids at the amino terminal end or carboxy terminal of a polypeptide that are not normally part of a polypeptide that is present in a wild-type cell.

As used herein, "hydrogenase activity" refers to the ability of a polypeptide(s) to catalyze the formation of reductants such as NADPH from molecular hydrogen ($H_2$), and also refers to the ability to catalyze the reverse reaction.

As used herein, "identity" refers to structural similarity between two polypeptides or two polynucleotides. The structural similarity between two polypeptides is determined by aligning the residues of the two polypeptides (e.g., a candidate amino acid sequence and a reference amino acid sequence) to optimize the number of identical amino acids along the lengths of their sequences; gaps in either or both sequences are permitted in making the alignment in order to optimize the number of shared amino acids, although the amino acids in each sequence must nonetheless remain in their proper order. The structural similarity is typically at least 80% identity, at least 81% identity, at least 82% identity, at least 83% identity, at least 84% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, or at least 99% identity. A candidate amino acid sequence can be isolated from a microbe, such as a *Pyrococcus* spp., including *P. furiosus*, or a *Metallosphaera* spp., including *M. sedula* or can be produced using recombinant techniques, or chemically or enzymatically synthesized. Structural similarity may be determined, for example, using sequence techniques such as the BESTFIT algorithm in the GCG package (Madison Wis.), or the Blastp program of the blastp suite-2sequences search algorithm, as described by Tatiana et al., (*FEMS Microbiol Lett*, 174, 247-250 (1999)), and available on the National Center for Biotechnology Information (NCBI) website. The default values for all blastp suite-2sequences search parameters may be used, including general parameters: expect threshold=10, word size=3, short queries=on; scoring parameters: matrix=BLOSUM62, gap costs=existence:11 extension:1, compositional adjustments=conditional compositional score matrix adjustment. Alternatively, polypeptides may be compared using the BESTFIT algorithm in the GCG package (version 10.2, Madison Wis.). In the comparison of two amino acid sequences using the BLAST search algorithm, structural similarity is referred to as "identities."

As used herein, an "isolated" substance is one that has been removed from its natural environment, produced using recombinant techniques, or chemically or enzymatically synthesized. For instance, a polypeptide or a polynucleotide described herein can be isolated. With respect to a product produced using a method described herein, "isolated" refers to removal of the product from the medium in which it was produced by a genetically engineered microbe. Preferably, a substance is purified, i.e., is at least 60% free, preferably at least 75% free, and most preferably at least 90% free from other components with which it is naturally associated, or from other components present in the medium in which it was produced.

As used herein, the tem. "polynucleotide" refers to a polymeric form of nucleotides of any length, either ribonucleotides or deoxynucleotides, and includes both double- and single-stranded RNA and DNA. A polynucleotide can be obtained directly from a natural source, or can be prepared with the aid of recombinant, enzymatic, or chemical techniques. A polynucleotide can be linear or circular in topology. A polynucleotide may be, for example, a portion of a vector, such as an expression or cloning vector, or a fragment. A polynucleotide may include nucleotide sequences having different functions, including, for instance, coding regions, and non-coding regions such as regulatory regions.

As used herein, the terms "coding region," "coding sequence," and "open reading frame" are used interchangeably and refer to a nucleotide sequence that encodes a polypeptide and, when placed under the control of appropriate regulatory sequences expresses the encoded polypeptide. The boundaries of a coding region are generally determined by a translation start codon at its 5' end and a translation stop codon at its 3' end. A "regulatory sequence" is a nucleotide sequence that regulates expression of a coding sequence to which it is operably linked. Non-limiting examples of regulatory sequences include promoters, enhancers, transcription initiation sites, translation start sites, translation stop sites, and transcription terminators. The term "operably linked" refers to a juxtaposition of components such that they are in a relationship permitting them to function in their intended manner. A regulatory sequence is "operably linked" to a coding region when it is joined in such a way that expression of the coding region is achieved under conditions compatible with the regulatory sequence.

As used herein, an "exogenous polypeptide" and "exogenous polynucleotide" refers to a polypeptide and polynucleotide, respectively, that is not normally or naturally found in a microbe, and/or has been introduced into a microbe. An exogenous polynucleotide may be separate from the genomic DNA of a cell (e.g., it may be a vector, such as a plasmid), or an exogenous polynucleotide may be integrated into the genomic DNA of a cell. A regulatory region, such as a promoter, that is present in the genomic DNA of a microbe but has been modified to have a nucleotide sequence that is different from the promoter normally present in the microbe is also considered an exogenous polynucleotide. An exogenous polynucleotide may encode an exogenous polypeptide or an endogenous polypeptide. For instance, a microbe may be transformed with a coding region that encodes a polypeptide that is naturally expressed by the microbe. Such a polypeptide is endogenous to that microbe, and it is encoded by an exogenous coding region. As used herein, the term "endogenous polypeptide" and "endogenous polynucleotide" refers to a polypeptide and polynucleotide, respectively, that is normally or naturally found in a microbe. An "endogenous polypeptide" is also referred to as a "native polypeptide," and an "endogenous polynucleotide" is also referred to as a "native polynucleotide."

The terms "complement" and "complementary" as used herein, refer to the ability of two single stranded polynucleotides to base pair with each other, where an adenine on one strand of a polynucleotide will base pair to a thymine or uracil on a strand of a second polynucleotide and a cytosine on one strand of a polynucleotide will base pair to a guanine on a strand of a second polynucleotide. Two polynucleotides are complementary to each other when a nucleotide sequence in one polynucleotide can base pair with a nucleotide sequence in a second polynucleotide. For instance, 5'-ATGC and 5'-GCAT are complementary. The term "substantial complement" and cognates thereof as used herein, refer to a polynucleotide that is capable of selectively hybridizing to a specified polynucleotide under stringent hybridization conditions. Stringent hybridization can take place under a number of pH, salt and temperature conditions. The pH can vary from 6 to 9, preferably 6.8 to 8.5. The salt concentration can vary from 0.15 M sodium to 0.9 M sodium, and other cations can be used as long as the ionic strength is equivalent to that specified for sodium. The temperature of the hybridization reaction can vary from 30° C. to 80° C., preferably from 45° C. to 70° C. Additionally, other compounds can be added to a hybridization reaction to promote specific hybridization at lower temperatures, such as at or approaching room temperature. Among the compounds contemplated for lowering the temperature requirements is formamide. Thus, a polynucleotide is typically substantially complementary to a second polynucleotide if hybridization occurs between the polynucleotide and the second polynucleotide. As used herein, "specific hybridization" refers to hybridization between two polynucleotides under stringent hybridization conditions.

As used herein, "genetically engineered microbe" and "microbe that has been genetically engineered" refers to a microbe which has been altered "by the hand of man." A genetically engineered microbe includes a microbe into which has been introduced an exogenous polynucleotide, e.g., an expression vector. Genetically engineered microbe also refers to a microbe that has been genetically manipulated such that endogenous nucleotides have been altered to include a mutation, such as a deletion, an insertion, a transition, a transversion, or a combination thereof. For instance, an endogenous coding region could be deleted. Such mutations may result in a polypeptide having a different amino acid sequence than was encoded by the endogenous polynucleotide. Another example of a genetically engineered microbe is one having an altered regulatory sequence, such as a promoter, to result in increased or decreased expression of an operably linked endogenous coding region.

As used herein, "optimum growth temperature" and "$T_{opt}$" refer to the optimal growth temperature of a microbe. The optimal growth temperature of a microbe is the temperature at which the doubling time is the shortest. The $T_{opt}$ of a thermophilic microbe is between 50° C. and no greater than 75° C., and the $T_{opt}$ of a hyperthermophilic microbe is between 75° C. and up to 100° C.

Conditions that are "suitable" for an event to occur, such as expression of an exogenous polynucleotide in a cell to produce a polypeptide, or production of a product, or "suitable" conditions are conditions that do not prevent such events from occurring. Thus, these conditions permit, enhance, facilitate, and/or are conducive to the event.

The term "and/or" means one or all of the listed elements or a combination of any two or more of the listed elements.

The words "preferred" and "preferably" refer to embodiments of the invention that may afford certain benefits, under certain circumstances. However, other embodiments may also be preferred, under the same or other circumstances. Furthermore, the recitation of one or more preferred embodiments does not imply that other embodiments are not useful, and is not intended to exclude other embodiments from the scope of the invention.

The terms "comprises" and variations thereof do not have a limiting meaning where these terms appear in the description and claims.

Unless otherwise specified, "a," "an," "the," and "at least one" are used interchangeably and mean one or more than one.

Also herein, the recitations of numerical ranges by endpoints include all numbers subsumed within that range (e.g., 1 to 5 includes 1, 1.5, 2, 2.75, 3, 3.80, 4, 5, etc.).

For any method disclosed herein that includes discrete steps, the steps may be conducted in any feasible order. And, as appropriate, any combination of two or more steps may be conducted simultaneously.

The above summary of the present invention is not intended to describe each disclosed embodiment or every implementation of the present invention. The description that follows more particularly exemplifies illustrative embodiments. In several places throughout the application, guidance is provided through lists of examples, which examples can be used in various combinations. In each instance, the recited list serves only as a representative group and should not be interpreted as an exclusive list.

BRIEF DESCRIPTION OF THE FIGURES

FIG. 3. 4-Hydroxybutyrate-CoA synthetase candidates in *M. sedula*. Normalized transcription levels for *M. sedula* genes annotated as small organic acid or fatty-acid ligases and synthetases. High transcription levels are shown in red, low transcription in green, corresponding numbers represent least-squares means of normalized log 2-transformed transcription levels relative to the overall average transcription level of 0 (black). Conditions shown: (2010)—Heterotrophic, Autotrophic, Mixotrophic; (2012)—Autotrophic Carbon Limited (ACL), Autotrophic Carbon Rich (ACR), Heterotrophic (HTR). Least-squares mean values are shown here for ACL condition for these genes, along with the fold change of genes under ACL relative to HTR and their statistical significance. All other microarray data can be found in the GEO deposit—GSE39944.

FIG. 8. Sequence alignment of S. enterica acetyl-CoA synthetase (STM4275) and M. sedula acyl-CoA ligases. Amino acid sequence alignment of active site residues in putative acyl-CoA ligases reveals a conserved glycine (shown in red) except for Msed_1353, which has a tryptophan indicative of acetate-propionate CoA ligases. Alignment was generated using Chimera by superposition of I-TASSER 3D structural models. Consensus SEQ ID NO: 400; STM4275, SEQ ID NO:401 (IMB Gene ID number 637214968); Msed_0394, SEQ ID NO:19 (IMB Gene ID number 640506300); Msed_0401, SEQ ID NO:20 (IMB Gene ID number 640506307); Msed_0406, SEQ ID NO:21 (IMB Gene ID number 640506312); Msed_1291, SEQ ID NO:22 (IMB Gene ID number 640507181); Msed_1353, SEQ ID NO:23 (IMB Gene ID number 640507242); and Msed_1422, SEQ ID NO:24 (IMB Gene ID number 640507311).

FIG. 28. Target genome regions in NCBI reference sequence versus COM1 sequence.

FIG. 29. SOE-PCR products for constructing pGL002 and pGL007 targeting genome regions 2 and 3. The nucleotide sequences of these are disclosed in Kelly et al. (WO 2013/067326)

FIG. 45. Annotated 2-oxoacid oxidoreductases in *M. sedula*. Normalized transcription levels for *M. sedula* genes annotated as pyruvate (or 2-oxoglutarate) flavodoxin/ferredoxin oxidoreductases. High transcription levels are shown in red, low transcription in green, corresponding numbers represent least-squares means of normalized log 2-transformed transcription levels relative to the overall average transcription level of 0 (black). Annotations are from the Joint Genome Institute's Integrated Microbial Genome database (img.jgi.doe.gov). Conditions shown: Autotrophic Carbon Limited (ACL), Autotrophic Carbon Rich (ACR), Heterotrophic (HTR). Fold change of gene transcription under ACL relative to HTR and their statistical significance is also shown. All other microarray data can be found in the GEO deposit—GSE39944.

FIG. 46. Amino acid sequences of polypeptides that are part of the 4-hydroxybutyrate cycle.

FIGS. 47-62: Each sequence is identified by the IMB Gene ID number used by the Department of Energy's Joint Genome Institute Integrated Microbial Genome database followed by the gene locus ID.

FIG. 47. An amino acid alignment of Msed_0147 (SEQ ID NO:1) and 18 other sequences. 640506050.Msed_0147 (SEQ ID NO:1), 650848362.Ahos_2119 (SEQ ID NO:25), 650472093.SiRe_0254, 643841501.YN1551_2862 (SEQ ID NO:26), 638192839.ST0593 (SEQ ID NO:402), 2508723726.Met . . . 1DRAFT_00020780 (SEQ ID NO:28), 646527065. LD85 0260 (SEQ ID NO:), 2524413480.SacN8_01265 (SEQ ID NO:29), 643828153.M1425_0254 (SEQ ID NO:30), 638197195.Saci_0260 (SEQ ID NO:31), 643830840.LS215_0285 (SEQ ID NO:32), 643882885.M164_0272 (SEQ ID NO:33), 650822319.Mcup_1926 (SEQ ID NO:34), 643836194.YG5714_0257 (SEQ ID NO:35), 638163678.SS02466 (SEQ ID NO:36), 650474851.SiH_0261 (SEQ ID NO:37), 646942932.Sso1_0270 (SEQ ID NO:38), 643842091.M1627_0254 (SEQ ID NO:39), 650023511.Sso198_010100000595 (SEQ ID NO:40).

FIG. 48. An amino acid alignment of Msed_0148 (SEQ ID NO:2) and 18 other sequences. 640506051.Msed_0148 (SEQ ID NO:2), 638192838.ST0592 (SEQ ID NO:41), 650822318.Mcup_1925 (SEQ ID NO:42), 2508723727. Met . . . 1DRAFT_00020790 (SEQ ID NO:43), 650848361.Ahos_2118 (SEQ ID NO:344), 638163677.SS02464 (SEQ ID NO:44), 643842090.M1627_0253 (SEQ ID NO:45), 646942931.Ssol_0269 (SEQ ID NO:46), 643828152.M1425_0253 (SEQ ID NO:47), 643882884.M164_0271 (SEQ ID NO:112), 643830839.LS215_0284 (SEQ ID NO:48), 643841500.YN1551_2861 (SEQ ID NO:49), 643836193.YG5714_0256 (SEQ ID NO:50), 650472092.SiRe_0253 (SEQ ID NO:51), 650474850.SiH_0260 (SEQ ID NO:52), 650023512.Sso198_010100000600 (SEQ ID NO:53), 646527064LD85_0259 (SEQ ID NO:54), 638197196.Saci_0261 (SEQ ID NO:55), 2524413481.SacN8_01270 (SEQ ID NO:56).

FIG. 49. An amino acid alignment of Msed_01375 (SEQ ID NO:3) and other sequences. 640507264.Msed_1375 (SEQ ID NO:3), 638192837.ST0591 (SEQ ID NO:57), 2508724172.Met . . . 1DRAFT_00025240 (SEQ ID NO:58), 650821248.Mcup_0858 (SEQ ID NO:59), 646527063.LD85_0258 (SEQ ID NO:60), 643842089.M1627_0252 (SEQ ID NO:61), 643841499.YN1551_2860 (SEQ ID NO:62), 643828151.M1425_0252 (SEQ ID NO:63), 643836192.YG5714_0255 (SEQ ID NO:64), 643830838LS215_0283 (SEQ ID NO:65), 646942930.Ssol_0268 (SEQ ID NO:66), 650023513.Sso198_010100000605 (SEQ ID NO:67), 643882883.M164_0270 (SEQ ID NO:68), 650474849.SiH_0259 (SEQ ID NO:69), 650472091.SiRe_0252 (SEQ ID NO:70), 650848360Ahos_2117 (SEQ ID NO:71), 2524413482.SacN8 01275 (SEQ ID NO:72), 638197197.Saci_0262 (SEQ ID NO:73), 638163676.5502463 (SEQ ID NO:74).

FIG. 50. An amino acid alignment of Msed_0709 (SEQ ID NO:4) and other sequences. 640506613.Msed_0709 (SEQ ID NO:4), 638194641.ST2171 (SEQ ID NO:75), 638199060.Saci_2147 (SEQ ID NO:76), 650848598.Ahos_2348 (SEQ ID NO:77), 643833336.LS215_2961 (SEQ ID NO:78), 646945396.Ssol_2908 (SEQ ID NO:79), 650025873.Sso198_010100012550 (SEQ ID NO80:), 643885393.M164_2777 (SEQ ID NO:81), 643830551M1425_2796 (SEQ ID NO:82), 643844535.M1627_2848 (SEQ ID NO:83), 2524415528.SacN8_11535 (SEQ ID NO:84), 650474573.SiRe_2691 (SEQ ID NO:85), 643841782.YN1551_3167 (SEQ ID NO:86), 2524415315.SacN8_10450 (SEQ ID NO:87), 638199277.Saci_2370 (SEQ ID NO:88), 643838884.YG5714_2976 (SEQ ID NO:89), 650477400.SiH_2755 (SEQ ID NO:90), 646529769.LD85_3126 (SEQ ID NO:91), 638163414.SS02178 (SEQ ID NO:92), 2508722882. Met . . . 1DRAFT_00012340 (SEQ ID NO:93), 650821817Mcup_1427 (SEQ ID NO:94).

FIG. 51. An amino acid alignment of Msed_1993 (SEQ ID NO:5) and other sequences. 640507881.Msed_1993 (SEQ ID NO:5), 2508724800.Met . . . 1DRAFT_00031520 (SEQ ID NO:95), 650025277. Sso198_010100009521 (SEQ ID NO:96), 638161868.SS00647 (SEQ ID NO:97), 643829267.M1425_1490 (SEQ ID NO:98), 643837420.YG5714_1494 (SEQ ID NO:99), 643832024.LS215_1598 (SEQ ID NO:100), 643840152.YN1551_1342 (SEQ ID NO:101), 643884086.M164_1487 (SEQ ID NO:102), 643843312.M1627_1605 (SEQ ID NO:103), 650476065.SiH_1456 (SEQ ID NO:104), 646944319.Ssol_1706 (SEQ ID NO:105), 65084733 LAhos_1103 (SEQ ID NO:106), 2524414811.SacN8_07880 (SEQ ID NO:107), 650473222.SiRe_1366 (SEQ ID NO:108), 646528384.LD85_1697 (SEQ ID NO:109), 638198535.Saci_1623 (SEQ ID NO:110), 638193893. ST1507 (SEQ ID NO:111), 650820669.Mcup_0293 (SEQ ID NO:113).

FIG. 52. An amino acid alignment of Msed_1456 (SEQ ID NO:6) and other sequences. 640507344.Msed_1456 (SEQ ID NO:6), 650848309.Ahos_2066—(SEQ ID NO:114), 650821134.Mcup_0744 (SEQ ID NO:115), 638193050.ST0783 (SEQ ID NO:116), 639783349.Pisl 0270 (SEQ ID NO:117), 2508724181.Met . . . 1DRAFT_00025330 (SEQ ID NO:118), 639773672.Tpen_0893 (SEQ ID NO:119), 650847233.Ahos_1005 (SEQ ID NO:120), 2505689392.Pyrfu_0975 (SEQ ID NO:121), 650025593.Sso198_010100011130 (SEQ ID NO:122), 638164412.SS03203 (SEQ ID NO:123), 638198104.Saci_1184 (SEQ ID NO:124), 638171842.PAE2867 (SEQ ID NO:125), 2524414384.SacN8_05775 (SEQ ID NO:126), 650473925.SiRe 2035 (SEQ ID NO:127), 643832752.LS21-5 2320 (SEQ ID NO:128), 650476750.S1H 21-03 (SEQ ID NO:129), 643884788.M164_2161 (SEQ ID NO:130), 643838221.YG5714 2284 (SEQ ID NO:131), 646943552.Ssol 0940-(SEQ ID NO:132), 64383945 YN1-551 0632 (SEQ ID NO:133), 643829949.M1425_2-157 (SEQ ID NO:134), 643843952.M1627_2237 (SEQ ID NO:135), 646529117.LD85_2424 (SEQ ID NO:136).

FIG. 53. An amino acid alignment of Msed_2001 (SEQ ID NO:7) and other sequences. 640507889.Msed_2001 (SEQ ID NO:7), 638193901.ST1516 (SEQ ID NO:138), 650847323.Ahos_1095 (SEQ ID NO:139), 638198544.Saci_1633 (SEQ ID NO:140), 252441482.0.SacN807925 (SEQ ID NO:141), 650820662.Mcup_0286 (SEQ ID NO:142), 638161875.SS00654 (SEQ ID NO:143), 650025284.Sso198_010100009556 (SEQ ID NO:144), 2508724790.Met . . . 1DRAFT_00031420 (SEQ ID NO:145), 643843305.M1627_1597 (SEQ ID NO:146), 646528376.LD85_1689 (SEQ ID NO:147), 643840160.YN1551_1350 (SEQ ID NO:148), 643884079.M164_1479 (SEQ ID NO:149), 643832016.LS215_1590 (SEQ ID NO:150), 643837412.YG5714_1486 (SEQ ID NO:151), 646944326.Ssol_1713 (SEQ ID NO:152), 643829260.M1425_1482 (SEQ ID NO:153), 650476056.SiH_1448 (SEQ ID NO:154), 650473215.SiRe_1359 (SEQ ID NO:155).

FIG. 54. An amino acid alignment of Msed_1426 (SEQ ID NO:8) and other sequences. 640507315.Msed_1426 (SEQ ID NO:8), 638192718.ST0480 (SEQ ID NO:156), 650821199.Mcup_0809 (SEQ ID NO:157), 638197838.Saci_0911 (SEQ ID NO:158), 638161989.SS00764 (SEQ ID NO:159), 643831892.LS215_1474 (SEQ ID NO:160), 643843128.M1627_1428 (SEQ ID NO:161), 643828184.M1425_0286 (SEQ ID NO:162), 650473079.SiRe_1239 (SEQ ID NO:163), 646528184.1 . . . D85_1501 (SEQ ID NO:164), 643883965.M164_1370 (SEQ ID NO:165), 643842122.M1627_0286 (SEQ ID NO:166), 646942963.Ssol_0305 (SEQ ID NO:167), 643829150.M1425_1378 (SEQ ID NO:168), 650475916.SiH_1323 (SEQ ID NO:169), 643837294.YG5714_1372 (SEQ ID NO:170), 646944442.Ssol 1823 (SEQ ID NO:171), 643840284.YN1551_1469 (SEQ ID NO:172), 650848532. Ahos_2283 (SEQ ID NO:173), 2524414117.SacN8_04415 (SEQ ID NO:174), 650025399.Sso198_010100010101 (SEQ ID NO:175), 2508722637.Met . . . 1DRAFT00009890 (SEQ ID NO:176).

FIG. 55. An amino acid alignment of Msed_0639 (SEQ ID NO:9) and other sequences. 640506543.Msed_0639 (SEQ ID NO:9), 638192799.ST0554 (SEQ ID NO:177), 638197850.Saci_0923 (SEQ ID NO:178), 646527026.LD850221 (SEQ ID NO:179), 2524414129.SacN8_04475 (SEQ ID NO:180), 638163642.SS02426 (SEQ ID NO:181), 650024093.Sso198_010100003518 (SEQ ID NO:182), 2508722799.Met . . . 1DRAFT_00011510 (SEQ ID NO:183), 643882848.M164_0235 (SEQ ID NO:184), 646942892.Ssol_0230 (SEQ ID NO:185), 643828115.M1425_0216 (SEQ ID NO:186), 650474810.SiH_0222 (SEQ ID NO:187), 643842053.M1627 0216 (SEQ ID NO:188), 650821907.Mcup_1517 (SEQ ID NO:189), 643830802.LS215_0247 (SEQ ID NO:190), 643841463.YN1551_2823 (SEQ ID NO:191), 650848464.Ahos_2217 (SEQ ID NO:192), 650472052.SiRe_0215 (SEQ ID NO:193), 643836157.YG57140220 (SEQ ID NO:194).

FIG. 56. An amino acid alignment of Msed_0638 (SEQ ID NO:10) and other sequences. 640506542.Msed_0638 (SEQ ID NO:10), 638192798.ST0552 (SEQ ID NO:195), 638189489.APE1687 (SEQ ID NO:196), 650507277. VMUT_0924 (SEQ ID NO:197), 2524414130.SacN8_04480 (SEQ ID NO:198), 638197851.Saci_0924 (SEQ ID NO:199), 650821906.Mcup_1516 (SEQ ID NO:200), 648200341.Vdis_0037 (SEQ ID NO:201), 2508722798. Met . . . 1DRAFT_00011500 (SEQ ID NO:202), 2510092565.Calag_0472 (SEQ ID NO:203), 638163641.SS02425 (SEQ ID NO:204), 650024094.Sso198_010100003523 (SEQ ID NO:205), 646527025 LD85_0220 (SEQ ID NO:206), 643882847.M164_0234 (SEQ ID NO:207), 650472051.SiRe_0214 (SEQ ID NO:208), 643830801.LS215_0246 (SEQ ID NO:209), 646942891.Sso1 0229 (SEQ ID NO:210), 650848463.Ahos_2216 (SEQ ID NO:211), 643836156.YG5714_0219 (SEQ ID NO:212), 643828114.M1425_0215 (SEQ ID NO:213), 643841462.YN1551_2822 (SEQ ID NO:214), 650474809.SiH_0221 (SEQ ID NO:215), 643842052.M1627_0215 (SEQ ID NO:216), 648118006.ASAC 1077 (SEQ ID NO:217).

FIG. 57. An amino acid alignment of Msed_2055 (SEQ ID NO:11) and other sequences. 640507945.Msed_2055 (SEQ ID NO:11), 638194564ST2096 (SEQ ID NO:218), 638189488 APE1686 (SEQ ID NO:219), 650471903 SiRe_0075 (SEQ ID NO:220), 650474657 SiH_0076 (SEQ ID NO:221), 643827976.M1425_0076 (SEQ ID NO:222), 646942747 Sso1_0081 (SEQ ID NO:223), 643882689.M164_0076 (SEQ ID NO:224), 643841912M1627_0076 (SEQ ID NO:226), 6438306311S215_0076 (SEQ ID NO:227), 646526885LD85_0076 (SEQ ID NO:228), 643838963.YN1551_0076 (SEQ ID NO:229), 643836014.YG5714_0078 (SEQ ID NO:230), 6482.00342.Vdis_0038 (SEQ ID NO:231), 650820610.Mcup_0235 (SEQ ID NO:232), 2510092566.Calag.0473 (SEQ ID NO:233), 250872472814et . . . IDRAFT_00030800 (SEQ ID NO:234), 638197003.Saci_0062 (SEQ ID NO:235), 2524413284.SacN8_00295 (SEQ ID NO:236), 650025504 Sso198_010100010675 (SEQ ID NO:237), 650846706 Abos_0509 (SEQ ID NO:238), 638163495.SS02266 (SEQ ID NO:239), 648118007ASAC_1078 (SEQ ID NO:240), 650507278.VMUT_0925 (SEQ ID NO:241).

FIG. 58. An amino acid alignment of Msed_1424 (SEQ ID NO:12) and other sequences. 640507313.Msed_1424 (SEQ ID NO:12), 638194516.ST2056 (SEQ ID NO:242), 2524415313.SacN8_10440 (SEQ ID NO:243), 638161699.5500472 (SEQ ID NO:244), 646944079.Sso1_1454 (SEQ ID NO:245), 643829410.M1425_1632 (SEQ ID NO:246), 643839999.YN1551_1180 (SEQ ID NO:247), 643884283.M164_1679 (SEQ ID NO:248), 643837646.YG5714_1723 (SEQ ID NO:249), 643832179.LS215_1759 (SEQ ID NO:250), 643843451.M1627_1747 (SEQ ID NO:251), 650473386.SiRe_1527 (SEQ ID NO:252), 650848525.Ahos_2277 (SEQ ID NO:253), 650476220.SiH_1606 (SEQ ID NO:254), 646528572.LD85_1888 (SEQ ID NO:255), 638199058.Saci_2145 (SEQ ID NO:256), 650821201.Mcup_0811 (SEQ ID NO:257), 650024197.Sso198_010100004040 (SEQ ID NO:258), 2508722628.Met . . . 1DRAFT_00009800 (SEQ ID NO:259).

FIG. 59. An amino acid alignment of Msed_0406 (SEQ ID NO:14) and other sequences. 640506312.Msed_0406 (SEQ ID NO:14), 638193516.ST1190 (SEQ ID NO:345), 638195071.ST2575 (SEQ ID NO:346), 641669006.Tneu_1843 (SEQ ID NO:347), 650847233.Ahos_1005 (SEQ ID NO:348), 650821270.Mcup_0880 (SEQ ID NO:260), 638163277.SS02041 (SEQ ID NO:261), 638163135.SS01903n (SEQ ID NO:262), 638198069.Saci_1149 (SEQ ID NO:263), 650772447.TUZN 2145 (SEQ ID NO:264), 648117514.ASAC_0597 (SEQ ID NO:265), 2508723436.Met . . . 1DRAFT_00017880 (SEQ ID NO:266), 643840674.YN1551_1878 (SEQ ID NO:267), 643883328.M164 0732 (SEQ ID NO:268), 650472518.SiRe_0686 (SEQ ID NO:269), 2524414348.SacN8_05595 (SEQ ID NO:270), 646527485.LD85_0753 (SEQ ID NO:271), 646945208.Sso1_2702 (SEQ ID NO:272), 650822064.Mcup_1674 (SEQ ID NO:273), 643828660.M1425_0851 (SEQ ID NO:274), 643831217.LS215 0753 (SEQ ID NO:275), 650024986.Sso198_010100008026 (SEQ ID NO:276), 643831373.LS215_0923 (SEQ ID NO:277), 643828535.M1425_0704 (SEQ ID NO:278), 650475223.SiH_0646 (SEQ ID NO:279), 643842477.M1627_0708 (SEQ ID NO:349), 643836911.YG5714_0994 (SEQ ID NO:350), 650508650.VMUT 2290 (SEQ ID NO:351).

FIG. 60. An amino acid alignment of Msed_1321 (SEQ ID NO:15) and other sequences. 640507210.Msed_1321 (SEQ ID NO:15), 650821278. Mcup_0888 (SEQ ID NO:352), 2511627386.1TX_1102 (SEQ ID NO:353), 650848279.Ahos_2036 (SEQ ID NO:355), 650024685.Sso198_010100006527 (SEQ ID NO:356), 638163940.SS02738 (SEQ ID NO:357), 638171713. PAE2693 (SEQ ID NO:358), 638194068ST1659 (SEQ ID NO:359), 2508721913. Met . . . 1DRAFT_00002650 (SEQ ID NO:360), 2512378777.Pogu_1298 (SEQ ID NO:361), 638199056.Saci_2143 (SEQ ID NO:362), 2524415311.SacN810430 (SEQ ID NO:363), 640125146.Pcal_1396 (SEQ ID NO:364), 641667580.Tneu_0422 (SEQ ID NO:365), 2511694157.P186_0718 (SEQ ID NO:366), 643833127.LS215_2744 (SEQ ID NO:367), 643830347341425_2585 (SEQ ID NO:368), 643844328M1627_2638 (SEQ ID NO:369), 639783328.Pis1_0248 (SEQ ID NO:370), 650477167.S1H_2522 (SEQ ID NO:371), 643839021.YN1551_0139 (SEQ ID NO:372), 640897163.Igni_0595 (SEQ ID NO:373), 643885186.M164_2569 (SEQ ID NO:374), 650474246.SiRe_2362 (SEQ ID NO:375), 643838664.YG5714_2751 (SEQ ID NO:376), 646943192.Sso1_0550 (SEQ ID NO:377), 646529546.LD85 2896 (SEQ ID NO:378).

FIG. 61. An amino acid alignment of Msed_0399 (SEQ ID NO:16) and other sequences. 640506305.Msed_0399 (SEQ ID NO:16), 2508723442.Met . . . 1DRAFT_00017940 (SEQ ID NO:379), 648117957.ASAC_1031 (SEQ ID NO:380), 638170750.PAE1383 (SEQ ID NO:381), 643841549.YN1551_2911 (SEQ ID NO:382), 643882933.M164_0319 (SEQ ID NO:383), 643842139.M1627_0303 (SEQ ID NO:384), 641667694.Tneu_0541 (SEQ ID NO:385), 643828200.M1425_0302 (SEQ ID NO:386), 650472146.SiRe_0307 (SEQ ID NO:387), 650474900.SiH_0309 (SEQ ID NO:388), 646942979.Sso1_0321 (SEQ ID NO:389), 639784518Pis1_1434 (SEQ ID NO:390), 640468018.Pars_0453 (SEQ ID NO:391), 640897631.Igni_1058 (SEQ ID NO:392), 646527111 LD85_0308 (SEQ ID NO:393), 650023499.Sso198_010100000535 (SEQ ID NO:394), 638163722.SS02514 (SEQ ID NO:395), 638196031.Saci_1109 (SEQ ID NO:396), 2524414310.SacN8_05395 (SEQ ID NO:397), 638189274 APE1484 (SEQ ID NO:398), 65082207014cup_1680 (SEQ ID NO:399).

FIG. 62. An amino acid alignment of Msed_0656 (SEQ ID NO:17) and other sequences. 640506560Msed_0656 (SEQ ID NO:17), 638192756.ST0514 (SEQ ID NO:280), 650770713.TUZN_0403 (SEQ ID NO:281), 650821827.Mcup_1437 (SEQ ID NO:282), 646942850Sso1_0188 (SEQ ID NO:283), 643841420.YN1551_2779 (SEQ ID NO:284), 650848421.Ahos_2176 (SEQ ID NO:285), 641667412.Tneu_0249 (SEQ ID NO:286), 638197890.Saci_0963 (SEQ ID NO:287), 650472007.SiRe_0173 (SEQ ID NO:288), 643836114.YG5714_0177 (SEQ ID NO:289), 643842011.M1627_0173 (SEQ ID NO:290), 650474766.SiH_0179 (SEQ ID NO:291), 643830761_LS215_0204 (SEQ ID NO:292), 640124530.Pcal_0781 (SEQ ID NO:293), 640467886.Pars_0309 (SEQ ID NO:294), 643882805.M164_0192 (SEQ ID NO:295), 640897989.Igni_1401 (SEQ ID NO:296), 2512379618.Pogu_2093 (SEQ ID NO:297), 646526983.LD85 0177 (SEQ ID NO:298), 643828073M1425_0173 (SEQ ID NO:299), 2524414169.SacN8_04675 (SEQ ID NO:300), 2508722819.Met . . . 1DRAFT 00011710 (SEQ ID NO:301), 2511627177.TTX_0886 (SEQ ID NO:302), 650024136.Sso198_010100003733 (SEQ ID NO:303), 638163597.SS02377 (SEQ ID NO:304), 648117228.ASAC_0321 (SEQ ID NO:305).

DETAILED DESCRIPTION OF ILLUSTRATIVE EMBODIMENTS

Provided herein are systems for sequestering carbon dioxide from the atmosphere using hydrogen gas as the driving force to convert the carbon to C2, C3, and C4 compounds, including compounds useful in the production of biofuels and plastics. In one embodiment, the system is a complete cycle. This cycle, also referred to herein as the 4-hydroxybutyrate cycle, can be broken down into three sub-pathways, as shown in equations 1-3, $$\text{Acetyl CoA} + CO_2 + ATP + 2H_2 \rightarrow \text{3-HP} + ADP + Pi + CoA \quad [1]$$

$$\text{3-HP} + CO_2 + 2ATP + 3H_2 \rightarrow \text{4-HB} + ADP + AMP + Pi + PPi \quad [2]$$

$$\text{4-HB} + ATP + NAD{+} + 2CoA \rightarrow 2 \text{ Acetyl CoA} + AMP + PPi + NADH \quad [3]$$

where 3-HP is 3-hydroxypropionate, and 4-HB is 4-hydroxybutyrate. The reaction described in equation 1 is also referred to herein as the 3-HP subpathway or SP1, and the reaction described in equation 2 is also referred to herein as the 4-HB subpathway or SP2. Thus, the system described herein can be used to produce 3-HP, 4-HB, acetyl CoA, or a combination thereof. In some embodiments other compounds may be produced, as described in greater detail herein.

Figure 1:
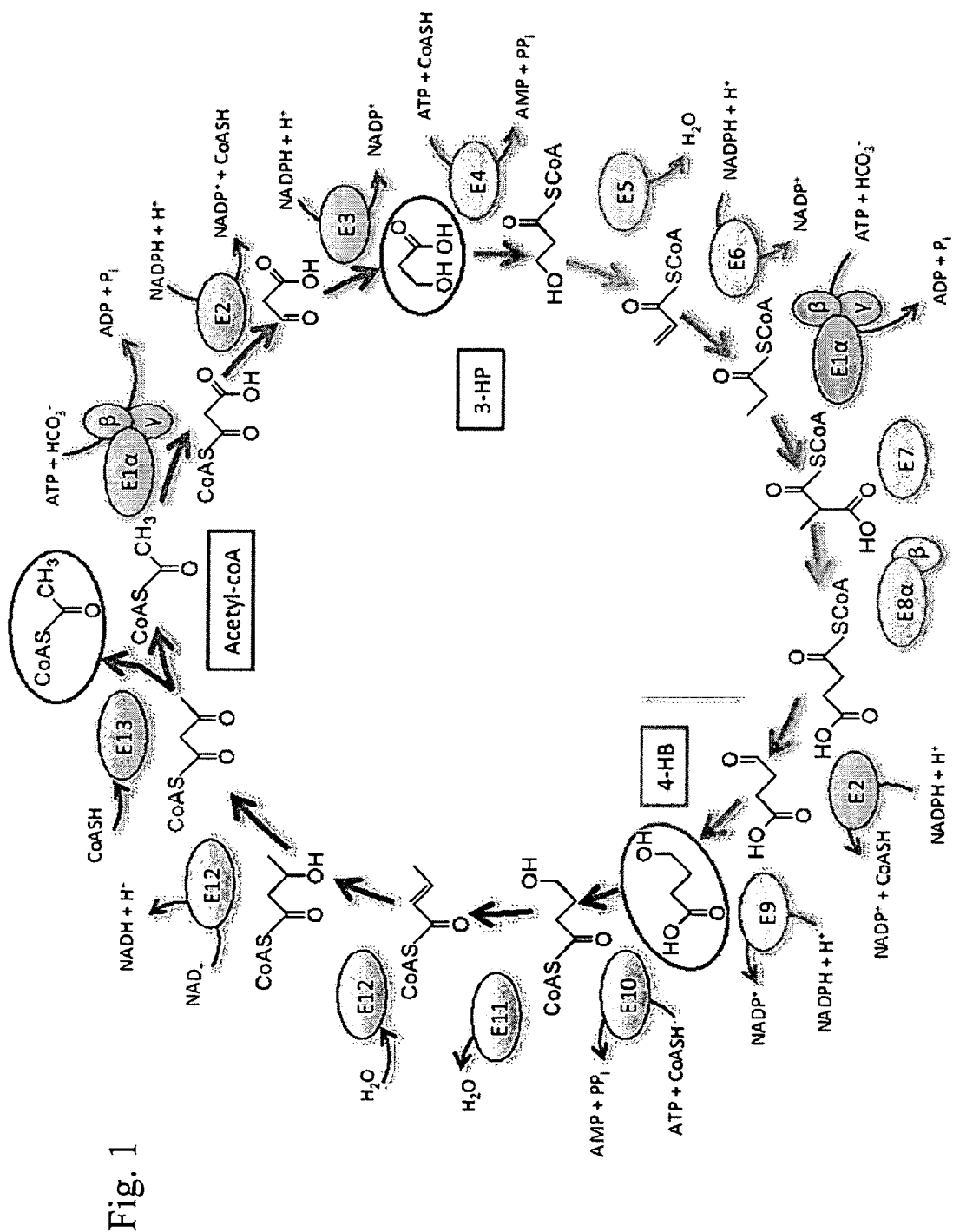
FIG. 1. Enzymes and substrates reactions of the 3HP/4HB cycle in *M. sedula*. E1α, β, γ, acetyl/propionyl-CoA carboxylase; E2, malonyl/succinyl-CoA reductase; E3, malonate semialdehyde reductase; E4, 3-hydroxypropionate:CoA ligase; E5, 3-hydroxypropionyl-CoA dehydratase; E6, acryloyl-CoA reductase; E7, methylmalonyl-CoA epimerase; E8, methylmalonyl-CoA mutase; E9, succinate semialdehyde reductase; E10, 4-hydroxybutyrate-CoA ligase; E11, 4-hydroxybutyryl-CoA dehydratase; E12, crotonyl-CoA hydratase/(S)-3hydroxybutyryl-CoA dehydrogenase; E13, acetoacetyl-CoA β-ketothiolase.

In one embodiment, which is described by equation 1 and shown in FIG. 1 as catalyzed by enzymes E1α, β, γ, E2, and E3, the system includes a polypeptide having acetyl/propionyl-CoA carboxylase activity (E1α, β, γ), a polypeptide having malonyl/succinyl-CoA reductase activity (E2), and a polypeptide having malonate semialdehyde reductase activity (E3). In one aspect of this embodiment, the system produces 3-HP. Aspects of the production of 3-HP, including useful carbon donors and electron donors, are discussed herein.

A polypeptide having acetyl/propionyl-CoA carboxylase activity means the polypeptide catalyzes the conversion of acetyl CoA to malonyl-CoA or the conversion of propionyl-CoA to (S)-methylmalonyl-CoA. The acetyl/propionyl-CoA carboxylase activity of a polypeptide may be determined by routine methods known in the art.

An example of a polypeptide having acetyl/propionyl-CoA carboxylase activity is a heterotrimeric polypeptide that includes one amino acid sequence encoded by coding sequence Msed_0147 of Genbank accession NC_009440 and disclosed at SEQ ID NO:1, one amino acid sequence encoded by coding sequence Msed_0148 of Genbank accession NC_009440 and disclosed at SEQ ID NO:2, and one amino acid sequence encoded by coding sequence Msed_1375 of Genbank accession NC_009440 and disclosed at SEQ ID NO:3.

Other examples of polypeptides having acetyl/propionyl-CoA carboxylase activity include a polypeptide having structural similarity to the amino acid sequence encoded by coding sequence Msed_0147 of Genbank accession NC_009440 and disclosed at SEQ ID NO:1, a polypeptide having structural similarity to the amino acid sequence encoded by coding sequence Msed_0148 of Genbank accession NC_009440 and disclosed at SEQ ID NO:2, and/or a polypeptide having structural similarity to the amino acid sequence encoded by coding sequence Msed_1375 of Genbank accession NC_009440 and disclosed at SEQ ID NO:3. A candidate polypeptide having structural similarity to one of the polypeptides SEQ ID NO:1, 2, or 3 has acetyl/propionyl-CoA carboxylase activity when expressed in a microbe with the other 2 reference polypeptides. For instance, when determining if a candidate polypeptide having some level of identity to SEQ ID NO:1 has acetyl/propionyl-CoA carboxylase activity, the candidate polypeptide is expressed in a microbe with reference polypeptides SEQ ID NO:2 and 3. When determining if a candidate polypeptide having some level of identity to SEQ ID NO:2 has acetyl/propionyl-CoA carboxylase activity, the candidate polypeptide is expressed in a microbe with reference polypeptides SEQ ID NO:1 and 3. When determining if a candidate polypeptide having some level of identity to SEQ ID NO:3 has acetyl/propionyl-CoA carboxylase activity, the candidate polypeptide is expressed in a microbe with reference polypeptides SEQ ID NO:1 and 2.

Additional examples of polypeptides expected to have acetyl/propionyl-CoA carboxylase activity may be obtained from members of the orders Sulfolobaceae (such as *Metallosphaera sedula* DSM 5348, *M. yellowstonensis*, *M. prunae*, and *M. cuprina* Ar-4, *Acidianus hospitalis* W1, *Sulfolobus tokodaii* str. 7, *S. acidocaldarius* DSM 639, *S. islandicus* Y.G.57.14, *S. islandicus* YN.15.51, *S. islandicus* L.S.2.15, *S. islandicus* L.D.8.5, *S. islandicus* M.16.4, *S. solfataricus* P2, and *S. islandicus* M.14.25) and Chloroflexales (such as *Chloroflexus* sp. Y-400-fl, *C. aurantiacus* J-10-fl, and *C. aggregans* DSM 9485).

A polypeptide having malonyl/succinyl-CoA reductase activity means the polypeptide catalyzes the conversion of malonyl-CoA to malonate semialdehyde or succinyl-CoA to succinate semialdehyde. The malonyl/succinyl-CoA reductase activity of a polypeptide may be determined by routine methods known in the art. An example of such a polypeptide includes an amino acid sequence encoded by coding sequence Msed_0709 of Genbank accession NC_009440 and disclosed at SEQ ID NO:4.

Other examples of polypeptides having malonyl/succinyl-CoA reductase activity include a polypeptide having structural similarity to the amino acid sequence encoded by coding sequence Msed_0709 of Genbank accession NC_009440 and disclosed at SEQ ID NO:4.

Additional examples of polypeptides expected to have malonyl/succinyl-CoA reductase activity may be obtained from members of the orders Sulfolobaceae (such as *Metallosphaera sedula* DSM 5348, *M. yellowstonensis*, *M. prunae*, and *M. cuprina* Ar-4, *Acidianus hospitalis* W1, *Sulfolobus tokodaii* str. 7, *S. acidocaldarius* DSM 639, *S. islandicus* Y.G.57.14, *S. islandicus* Y.N.15.51, *S. islandicus* L.S.2.15, *S. islandicus* L.D.8.5, *S. islandicus* M.16.4, *S. solfataricus* P2, and *S. islandicus* M.14.25) and Desulfurococcales (such as *Ignicoccus hospitalis* KIN4/I) and Euryarchaeotes (Thermococcales) (such as *Pyrococcus* sp. NA2), and Chloroflexales (such as *Chloroflexus* sp. Y-400-fl, *C. aurantiacus* J-10-fl, and *C. aggregans* DSM 9485).

A polypeptide having malonate semialdehyde reductase activity means the polypeptide catalyzes the conversion of malonate semialdehyde to 3-hydroxypropionate. The malonate semialdehyde reductase activity of a polypeptide may be determined by routine methods known in the art. An example of such a polypeptide includes one amino acid sequence encoded by coding sequence Msed_1993 of Genbank accession NC_009440 and disclosed at SEQ ID NO:5.

Other examples of polypeptides having malonate semialdehyde reductase activity include a polypeptide having structural similarity to the amino acid sequence encoded by coding sequence Msed_1993 of Genbank accession NC_009440 and disclosed at SEQ ID NO:5.

Additional examples of polypeptides expected to have malonate semialdehyde reductase activity may be obtained from members of the order Sulfolobaceae (such as *Metallosphaera sedula* DSM 5348, *M. yellowstonensis*, *M. prunae*, and *M. cuprina* Ar-4, *Acidianus hospitalis* W1, *Sulfolobus tokodaii* str. 7, *S. acidocaldarius* DSM 639, *S. islandicus* Y G.57.14, *S. islandicus* Y.N.15.51, *S. islandicus* L.S.2.15, *S. islandicus* L.D.8.5, *S. islandicus* M.16.4, *S. solfataricus* P2, and *S. islandicus* M14.25).

In one embodiment, which is described by equation 2 and shown in FIG. 1 as catalyzed by enzymes E4, E5, E6, E7, and E8α and β, the system includes a polypeptide having 3-hydroxypropionate:CoA ligase activity (E4), a polypeptide having 3-hydroxypropionyl-CoA dehydratase activity (E5), a polypeptide having acryloyl-CoA reductase activity (E6), a polypeptide having methylmalonyl-CoA epimerase activity (E7), a polypeptide having methylmalonyl-CoA mutase activity (E8αβ), and a polypeptide having succinate semialdehyde reductase activity (E9). In one aspect of this embodiment, the system produces 4-HB. The system may also include a polypeptide having acetyl/propionyl-CoA carboxylase activity (E1α, β, γ), a polypeptide having malonyl/succinyl-CoA reductase activity (E2), polypeptides which are described above. Aspects of the production of 4-HB, including useful carbon donors and electron donors, are discussed herein.

A polypeptide having 3-hydroxypropionate:CoA ligase activity means the polypeptide catalyzes the conversion of 3-hydroxypropionate to 3-hydroxypropionyl CoA. The 3-hydroxypropionate:CoA ligase activity of a polypeptide may be determined by routine methods known in the art. An example of such a polypeptide includes an amino acid sequence encoded by coding sequence Msed_1456 of Genbank accession NC_009440 and disclosed at SEQ ID NO:6.

Other examples of polypeptides having 3-hydroxypropionate:CoA ligase activity include a polypeptide having structural similarity to the amino acid sequence encoded by coding sequence Msed_1456 of Genbank accession NC_009440 and disclosed at SEQ ID NO:6.

Additional examples of polypeptides expected to have 3-hydroxypropionate:CoA ligase activity may be obtained from members of the orders Sulfolobaceae (such as *Metallosphaera sedula* DSM 5348, *M. yellowstonensis*, *M. prunae*, and *M. cuprina* Ar-4, *Acidianus hospitalis* W1, *Sulfolobus tokodaii* str. 7, *S. acidocaldarius* DSM 639, *S. islandicus* Y.G.57. 14, *S. islandicus* Y.N. 15.51, *S. islandicus* L.S.2.15, *S. islandicus* L.D.8.5, *S. islandicus* M.16.4, *S. solfataricus* P2, and *S. islandicus* M14.25), Thermoproteales (such as *Vulcanisaeta moutnovskia* 768-28 and *V. distributa* DSM 14429), Acidilobales (such as *Acidilobus saccharovorans* 345-15), and Euryarchaeotes (Thermococcales) (such as *Thermococcus sibiricus* MM 739, *T. barophilus* MP, *Pyrococcus furiosus* DSM 3638, *Pyrococcus* sp. NA2, *P. horikoshii* OT3, *Thermococcus gammatolerans* EJ3).

A polypeptide having 3-hydroxypropionyl-CoA dehydratase activity means the polypeptide catalyzes the conversion of 3-hydroxypropionyl-CoA to acryloyl-CoA. The 3-hydroxypropionyl-CoA dehydratase activity of a polypeptide may be determined by routine methods known in the art. An example of such a polypeptide includes an amino acid sequence encoded by coding sequence Msed_2001 of Genbank accession NC_009440 and disclosed at SEQ ID NO:7.

Other examples of polypeptides having 3-hydroxypropionyl-CoA dehydratase activity include a polypeptide having structural similarity to the amino acid sequence encoded by coding sequence Msed_2001 of Genbank accession NC_009440 and disclosed at SEQ ID NO:7.

Additional examples of polypeptides expected to have 3-hydroxypropionyl-CoA dehydratase activity may be obtained from members of the orders Sulfolobaceae (such as *Metallosphaera sedula* DSM 5348, *M. yellowstonensis*, *M. prunae*, and *M. cuprina* Ar-4, *Acidianus hospitalis* W1, *Sulfolobus tokodaii* str. 7, *S. acidocaldarius* DSM 639, *S. islandicus* Y G.57.14, *S. islandicus* Y.N.15.51, *S. islandicus* L.S.2.15, *S. islandicus* L.D.8.5, *S. islandicus* M.16.4, *S. solfataricus* P2, and *S. islandicus* M14.25), Thermoproteales (such as *Vulcanisaeta distributa* DSM 14429), Acidilobales (such as *Acidilobus saccharovorans* 345-15), and Desulfurococcales (such as *Aeropyrum pernix* K1).

A polypeptide having acryloyl-CoA reductase activity means the polypeptide catalyzes the conversion of acryloyl-CoA to propionyl-CoA. The acryloyl-CoA reductase activity of a polypeptide may be determined by routine methods known in the art. An example of such a polypeptide includes an amino acid sequence encoded by coding sequence Msed_1426 of Genbank accession NC_009440 and disclosed at SEQ ID NO:8.

Other examples of polypeptides having acryloyl-CoA reductase activity include a polypeptide having structural similarity to the amino acid sequence encoded by coding sequence Msed_1426 of Genbank accession NC_009440 and disclosed at SEQ ID NO:8.

Additional examples of polypeptides expected to have acryloyl-CoA reductase activity may be obtained from members of the orders Sulfolobaceae (such as *Metallosphaera sedula* DSM 5348, *M. yellowstonensis*, *M. prunae*, and *M. cuprina* Ar-4, *Acidianus hospitalis* W1, *Sulfolobus tokodaii* str. 7, *S. acidocaldarius* DSM 639, *S. islandicus* Y.G.57.14, *S. islandicus* Y.N.15.51, *S. islandicus* L.S.2.15, *S. islandicus* L.D.8.5, *S. islandicus* M.16.4, *S. solfataricus* P2, and *S. islandicus* M14.25), and Thermoproteales (such as *Vulcanisaeta moutnovskia* 768-28 and *V. distributa* DSM 14429).

A polypeptide having methylmalonyl-CoA epimerase activity means the polypeptide catalyzes the conversion of (S)-methylmalonyl-CoA to (R)-methylmalonyl-CoA. The methylmalonyl-CoA epimerase activity of a polypeptide may be determined by routine methods known in the art. An example of such a polypeptide includes an amino acid sequence encoded by coding sequence Msed_0639 of Genbank accession NC_009440 and disclosed at SEQ ID NO:9.

Other examples of polypeptides having methylmalonyl-CoA epimerase activity include a polypeptide having structural similarity to the amino acid sequence encoded by coding sequence Msed_0639 of Genbank accession NC_009440 and disclosed at SEQ ID NO:9.

Additional examples of polypeptides expected to have methylmalonyl-CoA epimerase activity may be obtained from members of the orders Sulfolobaceae (such as *Metallosphaera sedula* DSM 5348, *M. yellowstonensis*, *M. prunae*, and *M. cuprina* Ar-4, *Acidianus hospitalis* W1, *Sulfolobus tokodaii* str. 7, *S. acidocaldarius* DSM 639, *S. islandicus* Y.G.57.14, *S. islandicus* Y.N.15.51, *S. islandicus* L.S.2.15, *S. islandicus* L.D.8.5, *S. islandicus* M.16.4, *S. solfataricus* P2, and *S. islandicus* M14.25), Thermoproteales (such as *Vulcanisaeta distributa* DSM 14429), Euryarchaeotes (Thermococcales) (such as *Thermococcus sibiricus* MM 739, *T. barophilus* MP, *Pyrococcus furiosus* DSM 3638, *Pyrococcus* sp. NA2, *P. horikoshii* OT3, *T. gammatolerans* EJ3, *P. abyssi* GE5, and *Thermococcus onnurineus* NA1), and Chloroflexales (such as *Chloroflexus* sp. Y-400-fl, *C. aurantiacus* J-10-fl, and *C. aggregans* DSM 9485).

An example of a polypeptide having methylmalonyl-CoA mutase activity is a heterodimeric polypeptide that includes one amino acid sequence encoded by coding sequence Msed_0638 of Genbank accession NC_009440 and disclosed at SEQ ID NO:10, and one amino acid sequence encoded by coding sequence Msed_2055 of Genbank accession NC_009440 and disclosed at SEQ ID NO:11.

Other examples of polypeptides having methylmalonyl-CoA mutase activity include a polypeptide having structural similarity to the amino acid sequence encoded by coding sequence Msed_0638 of Genbank accession NC_009440 and disclosed at SEQ ID NO:10, and/or a polypeptide having structural similarity to the amino acid sequence encoded by coding sequence Msed_2055 of Genbank accession NC_009440 and disclosed at SEQ ID NO:11. A candidate polypeptide having structural similarity to one of the polypeptides SEQ ID NO:10 or 11 has methylmalonyl-CoA mutase activity when expressed in a microbe with the other reference polypeptide. For instance, when determining if a candidate polypeptide having some level of identity to SEQ ID NO:10 has methylmalonyl-CoA mutase activity, the candidate polypeptide is expressed in a microbe with reference polypeptide SEQ ID NO:11. When determining if a candidate polypeptide having some level of identity to SEQ ID NO:11 has methylmalonyl-CoA mutase activity, the candidate polypeptide is expressed in a microbe with reference polypeptide SEQ ID NO:10.

Additional examples of polypeptides expected to have methylmalonyl-CoA mutase activity may be obtained from members of the orders Sulfolobaceae (such as *Metallosphaera sedula* DSM 5348, *M. yellowstonensis*, *M. prunae*, and *M. cuprina* Ar-4, *Acidianus hospitalis* W1, *Sulfolobus tokodaii* str. 7, *S. acidocaldarius* DSM 639, *S. islandicus* Y.G.57.14, *S. islandicus* Y.N.15.51, *S. islandicus* L.S.2.15, *S. islandicus* L.D.8.5, *S. islandicus* M.16.4, *S. solfataricus* P2, and *S. islandicus* M14.25), Theimoproteales (such as *Vulcanisaeta moutnovskia* 768-28 and *V. distributa* DSM 14429), Acidilobales (such as *Acidilobus saccharovorans*

345-15), Desulfurococcales (such as *Aeropyrum pernix* K1), Euryarchaeotes (Thermococcales) (such as *Thermococcus sibiricus* MM 739, *T. barophilus* MP, *Pyrococcus furiosus* DSM 3638, *Pyrococcus* sp. NA2, *P. horikoshii* OT3, *T. gammatolerans* EJ3, *P. abyssi* GE5, and *Thermococcus onnurineus* NA1), and Chloroflexales (such as *Chloroflexus* sp. Y-400-fl, *C. aurantiacus* J-10-fl, and *C. aggregans* DSM 9485).

A polypeptide having succinate semialdehyde reductase activity means the polypeptide catalyzes the conversion of succinate semialdehyde to 4-hydroxybutyrate. The succinate semialdehyde reductase activity of a polypeptide may be determined by routine methods known in the art. An example of such a polypeptide includes an amino acid sequence encoded by coding sequence Msed_1424 of Genbank accession NC_009440 and disclosed at SEQ ID NO:12.

Other examples of polypeptides having succinate semialdehyde reductase activity include a polypeptide having structural similarity to the amino acid sequence encoded by coding sequence Msed_1424 of Genbank accession NC_009440 and disclosed at SEQ ID NO:12.

Additional examples of polypeptides expected to have semialdehyde reductase activity may be obtained from members of the order Sulfolobaceae (such as *Metallosphaera sedula* DSM 5348, *M. yellowstonensis*, *M. prunae*, and *M. cuprina* Ar-4, *Acidianus hospitalis* W1, *Sulfolobus tokodaii* str. 7, *S. acidocaldarius* DSM 639, *S. islandicus* Y.G.57.14, *S. islandicus* Y.N.15.51, *S. islandicus* L.S.2.15, *S. islandicus* L.D.8.5, *S. islandicus* M.16.4, *S. solfataricus* P2, and *S. islandicus* M.14.25).

In one embodiment, which is described by equation 3 and shown in FIG. 1 as catalyzed by enzymes E10, E11, E12, and E13, the system includes a polypeptide having a polypeptide having 4-hydroxybutyrate:CoA ligase activity (E10), a polypeptide having 4-hydroxybutyrl-CoA dehydratase activity (E11), a polypeptide having crotonyl-CoA hydratase/(S)-3-hydroxybutyryl-CoA dehydrogenase activity (E12), and a polypeptide having acetoacetyl-CoA β-ketothiolase activity (E13). In one aspect of this embodiment, the system produces acetyl-CoA. Aspects of the production of acetyl-CoA, including useful carbon donors and electron donors, are discussed herein.

A polypeptide having 4-hydroxybutyrate:CoA ligase activity means the polypeptide catalyzes the conversion of 4-hydroxybutyrate to 4-hydroxybutyryl-CoA. The 4-hydroxybutyrate:CoA ligase activity of a polypeptide may be determined by routine methods known in the art. An example of such a polypeptide includes an amino acid sequence encoded by coding sequence Msed_0394 of Genbank accession NC_009440 and disclosed at SEQ ID NO:13. Another example of a polypeptide having 4-hydroxybutyrate:CoA ligase activity includes an amino acid sequence encoded by coding sequence Msed_0406 of Genbank accession NC_009440 and disclosed at SEQ ID NO:14.

Other examples of polypeptides having 4-hydroxybutyrate:CoA ligase activity include a polypeptide having structural similarity to the amino acid sequence encoded by coding sequence Msed_0394 of Genbank accession NC_009440 and disclosed at SEQ ID NO:13 and a polypeptide having structural similarity to the amino acid sequence encoded by coding sequence Msed_0406 of Genbank accession NC_009440 and disclosed at SEQ ID NO:14.

In one embodiment, an example of a polypeptide having 4-hydroxybutyrate:CoA ligase activity is an amino acid sequence encoded by coding sequence Msed_1353 of Genbank accession NC_009440 and disclosed at SEQ ID NO:18, provided that the amino acid at residue 424 is not the tryptophan present in a wild type Msed_1353. In one embodiment, the amino acid at residue 424 is alanine, valine, leucine, isoleucine, or glycine. In one embodiment, the amino acid at residue 424 is alanine, valine, leucine, glycine. In one embodiment, the amino acid at residue 424 is glycine. The amino acid sequence disclosed at SEQ ID NO:18 includes the substitution of glycine for tryptophan Another example is a polypeptide having structural similarity to the amino acid sequence SEQ ID NO:18, provided the amino acid at residue 424 is not tryptophan.

Additional examples of polypeptides expected to have 4-hydroxybutyrate:CoA ligase activity include polypeptides catalyzing a CoA-ligase reaction that uses short (C2-C4) or medium (C5-C8) linear organic acids as a substrate. For instance, examples of polypeptides expected to have 4-hydroxybutyrate:CoA ligase activity include polypeptides catalyzing the reaction described under the IUBMB Enzyme Nomenclature system as EC 6.2.1.1, EC 6.2.1.3, EC 6.2.1.17, or EC 6.2.1.36. Such polypeptides may be obtained from members of the orders Desulfurococcales (such as *Ignicoccus hospitalis*, or *Pyrolobus fumarii*), Thermoproteales (such as *Thermoproteus neutrophilus*), or Sulfolobales (such as *Sulfolobus acidocaldarius*, *S. islandicus*, *S. solfataricus*, *S. tokodaii*, *Metallosphaera cuprina*, or *M. sedula*).

A polypeptide having 4-hydroxybutyryl-CoA dehydratase activity means the polypeptide catalyzes the conversion of 4-hydroxybutyryl-CoA to crotonyl-CoA. The 4-hydroxybutyryl-CoA dehydratase activity of a polypeptide may be determined by routine methods known in the art. An example of such a polypeptide includes an amino acid sequence encoded by coding sequence Msed_1321 of Genbank accession NC_009440 and disclosed at SEQ ID NO:15.

Other examples of polypeptides having 4-hydroxybutyryl-CoA dehydratase activity include a polypeptide having structural similarity to the amino acid sequence encoded by coding sequence Msed_1321 of Genbank accession NC_009440 and disclosed at SEQ ID NO:15.

Additional examples of polypeptides expected to have 4-hydroxybutyryl-CoA dehydratase activity may be obtained from members of the orders Sulfolobaceae (such as *Metallosphaera sedula* DSM 5348, *M. yellowstonensis*, *M. prunae*, and *M. cuprina* Ar-4, *Acidianus hospitalis* W1, *Sulfolobus tokodaii* str. 7, *S. acidocaldarius* DSM 639, *S. islandicus* Y.G.57.14, *S. islandicus* Y.N.15.51, *S. islandicus* L.S.2.15, *S. islandicus* L.D.8.5, *S. islandicus* M.16.4, *S. solfataricus* P2, and *S. islandicus* M.14.25), and Desulfurococcales (such as *Ignicoccus hospitalis* KIN4/I).

A polypeptide having crotonyl-CoA hydratase/(S)-3-hydroxybutyryl-CoA dehydrogenase activity means the polypeptide catalyzes the conversion of crotonyl-CoA to acetoacetyl-CoA. The crotonyl-CoA hydratase/(S)-3-hydroxybutyryl-CoA dehydrogenase activity of a polypeptide may be determined by routine methods known in the art. An example of such a polypeptide includes an amino acid sequence encoded by coding sequence Msed_0399 of Genbank accession NC_009440 and disclosed at SEQ ID NO:16.

Other examples of polypeptides having crotonyl-CoA hydratase/(S)-3-hydroxybutyryl-CoA dehydrogenase activity include a polypeptide having structural similarity to the amino acid sequence encoded by coding sequence Msed_0399 of Genbank accession NC_009440 and disclosed at SEQ ID NO:16.

Additional examples of polypeptides expected to have crotonyl-CoA hydratase/(S)-3-hydroxybutyrl-CoA dehydrogenase activity may be obtained from members of the orders Sulfolobaceae (such as *Metallosphaera sedula* DSM 5348, *M. yellowstonensis, M. prunae,* and *M. cuprina* Ar-4, *Acidianus hospitalis* W1, *Sulfolobus tokodaii* str. 7, *S. acidocaldarius* DSM 639, *S. islandicus* Y.G.57.14, *S. islandicus* YN.15.51, *S. islandicus* L.S.2.15, *S. islandicus* L.D.8.5, *S. islandicus* M.16.4, *S. solfataricus* P2, and *S. islandicus* M.14.25), Thermoproteales (such as *Vulcanisaeta moutnovskia* 768-28 and *V. distributa* DSM 14429), Acidilobales (such as *Acidilobus saccharovorans* 345-15), and Desulfurococcales (such as *Aeropyrum pernix* K1, and *Ignicoccus hospitalis* KIN4/I).

A polypeptide having acetoacetyl-CoA β-ketothiolase activity means the polypeptide catalyzes the conversion of acetoacetyl-CoA to acetyl-CoA. The acetoacetyl-CoA β-ketothiolase activity of a polypeptide may be determined by routine methods known in the art. An example of such a polypeptide includes an amino acid sequence encoded by coding sequence Msed_0656 of Genbank accession NC_009440 and disclosed at SEQ ID NO:17.

Other examples of polypeptides having acetoacetyl-CoA β-ketothiolase activity include a polypeptide having structural similarity to the amino acid sequence encoded by coding sequence Msed_0656 of Genbank accession NC_009440 and disclosed at SEQ ID NO:17.

Additional examples of polypeptides expected to have acetoacetyl-CoA β-ketothiolase dehydrogenase activity may be obtained from members of the orders Sulfolobaceae (such as *Metallosphaera sedula* DSM 5348, *M. yellowstonensis, M. prunae,* and *M. cuprina* Ar-4, *Acidianus hospitalis* W1, *Sulfolobus tokodaii* str. 7, *S. acidocaldarius* DSM 639, *S. islandicus* Y G.57.14, *S. islandicus* Y.N.15.51, *S. islandicus* L.S.2.15, *S. islandicus* L.D.8.5, *S. islandicus* M.16.4, *S. solfataricus* P2, and *S. islandicus* M14.25), Thermoproteales (such as *Vulcanisaeta moutnovskia* 768-28 and *V. distributa* DSM 14429), Acidilobales (such as *Acidilobus saccharovorans* 345-15), and Desulfurococcales (such as *Aeropyrum pernix* K1, and *Ignicoccus hospitalis* KIN4/I).

While this pathway is presented as a cycle, the skilled person will recognize and appreciate that acetyl-CoA used by the heterotrimer E1αβγ, acetyl/propionyl-CoA carboxylase, does not need to originate from the enzymatic activity of E13 (acetoacetyl-CoA β-ketothiolase). Acetyl-CoA may be produced through, for instance, the metabolism of amino acids, the degradation of fatty acids, or carbohydrate metabolism, and acetyl-CoA from any source may be the substrate of the heterotrimer E1αβγ.

A candidate polypeptide (e.g., a polypeptide having structural similarity to a polypeptide described herein) may be isolated from a microbe, such as an extremophile. An extremophile is an organism that survives and thrives in challenging conditions impossible for most organisms. Examples of extremophiles include thennophiles, hyperthermophiles, acidophiles, and combinations thereof (e.g., a thermoacidophile). "Thermophile" refers to prokaryotic microbes that grow in environments at temperatures of between 50° C. and no greater than 75° C. "Hyperthermophile" refers to prokaryotic microbes that grow in environments at temperatures of at least 75° C. "Acidophile" refers to prokaryotic microbes that grow in environments at a pH of 3 or less. A prokaryotic microbe may be a member of the domain Archaea or a member of the domain Bacteria. Examples of extremophiles include archaea such as, but not limited to, members of the Order Thermococcales, members of the Order Sulfolobales, and members of the Order Thermotogales. Members of the Order Thermococcales include, but are not limited to, a member of the genus *Pyrococcus*, for instance *P. furiosus, P. abyssi,* or *P. horikoshii*, a member of the genus *Thermococcus*, for instance, *T. kodakaraensis* or *T. onnurineus*. Members of the Order Sulfolobales include, but are not limited to, a member of the genus *Metallosphaera*, for instance, *M. sedula*. Members of the Order Thermotogales include, but are not limited to, members of the genus *Thermotoga*, for instance, *T. maritima* or *T. neapolitana*. A candidate polypeptide may be produced using recombinant techniques, or chemically or enzymatically synthesized.

The amino acid sequence of a polypeptide having structural similarity to a polypeptide described herein may include conservative substitutions of amino acids present in an amino acid sequence. A conservative substitution is typically the substitution of one amino acid for another that is a member of the same class. For example, it is well known in the art of protein biochemistry that an amino acid belonging to a grouping of amino acids having a particular size or characteristic (such as charge, hydrophobicity, and/or hydrophilicity) may generally be substituted for another amino acid without substantially altering the secondary and/or tertiary structure of a polypeptide. For the purposes of this invention, conservative amino acid substitutions are defined to result from exchange of amino acids residues from within one of the following classes of residues: Class I: Gly, Ala, Val, Leu, and Ile (representing aliphatic side chains); Class II: Gly, Ala, Val, Leu, Ile, Ser, and Thr (representing aliphatic and aliphatic hydroxyl side chains); Class III: Tyr, Ser, and Thr (representing hydroxyl side chains); Class IV: Cys and Met (representing sulfur-containing side chains); Class V: Glu, Asp, Asn and Gln (carboxyl or amide group-containing side chains); Class VI: His, Arg and Lys (representing basic side chains); Class VII: Gly, Ala, Pro, Trp, Tyr, Ile, Val, Leu, Phe and Met (representing hydrophobic side chains); Class VIII: Phe, Trp, and Tyr (representing aromatic side chains); and Class IX: Asn and Gln (representing amide side chains). The classes are not limited to naturally occurring amino acids, but also include artificial amino acids, such as beta or gamma amino acids and those containing non-natural side chains, and/or other similar monomers such as hydroxyacids.

Guidance concerning how to make phenotypically silent amino acid substitutions is provided in Bowie et al. (1990, Science, 247:1306-1310), wherein the authors indicate proteins are surprisingly tolerant of amino acid substitutions. For example, Bowie et al. disclose that there are two main approaches for studying the tolerance of a polypeptide sequence to change. The first method relies on the process of evolution, in which mutations are either accepted or rejected by natural selection. The second approach uses genetic engineering to introduce amino acid changes at specific positions of a cloned gene and selects or screens to identify sequences that maintain functionality. As stated by the authors, these studies have revealed that proteins are surprisingly tolerant of amino acid substitutions. The authors further indicate which changes are likely to be permissive at a certain position of the protein. For example, most buried amino acid residues require non-polar side chains, whereas few features of surface side chains are generally conserved. Other such phenotypically silent substitutions are described in Bowie et al, and the references cited therein.

Guidance on how to modify the amino acid sequences of polypeptides disclosed herein is also provided at FIGS. 47-62. These figures show the amino acid sequences of polypeptides disclosed herein (SEQ ID NOs:1-17) in multiple protein alignments with other related polypeptides.

Identical amino acids are marked with an asterisk ("*"), strongly conserved amino acids are marked with a colon (":"), and weakly conserved amino acids are marked with a period ("."). By reference to these figures, the skilled person can predict which alterations to an amino acid sequence are likely to modify enzymatic activity, as well as which alterations are unlikely to modify enzymatic activity.

A polypeptide described herein may be expressed as a fusion polypeptide that includes a polypeptide described herein and a heterologous amino acid sequence. The heterologous amino acid sequence may be present at the amino terminal end or the carboxy terminal end of a polypeptide, or it may be present within the amio acid sequence of the polypeptide. For instance, the heterologous amino acid sequence may be useful for purification of the fusion polypeptide by affinity chromatography. Various methods are available for the addition of such affinity purification tags to proteins. Examples of tags include a polyhistidine-tag, maltose-binding protein, and Strep-tag®. Representative examples may be found in Hopp et al. (U.S. Pat. No. 4,703,004), Hopp et al. (U.S. Pat. No. 4,782,137), Sgarlato (U.S. Pat. No. 5,935,824), Sharma (U.S. Pat. No. 5,594,115), and Skerra and Schmidt, 1999, Biomol Eng. 16:79-86). The heterologous amino acid sequence, for instance, a tag or a carrier, may also include a cleavable site that permits removal of most or all of the additional amino acid sequence. Examples of cleavable sites are known to the skilled person and routinely used, and include, but are not limited to, a TEV protease recognition site. The number of heterologous amino acids may be, for instance, at least 5, at least 10, at least 15, at least 20, at least 25, at least 30, at least 35, or at least 40.

The polypeptides described herein may be produced by using recombinant, synthetic, or chemical techniques. For instance, a polypeptide may be synthesized in vitro, e.g., by solid phase peptide synthetic methods. Solid phase peptide synthetic methods are routine and known in the art. A polypeptide produced using recombinant techniques or by solid phase peptide synthetic methods may be further purified by routine methods, such as fractionation on immunoaffinity or ion-exchange columns, ethanol precipitation, reverse phase HPLC, chromatography on silica or on an anion-exchange resin such as DEAE, chromatofocusing, SDS-PAGE, ammonium sulfate precipitation, gel filtration using, for example, Sephadex G-75, or ligand affinity A preferred method for isolating and optionally purifying a hydrogenase polypeptide described herein includes column chromatography using, for instance, ion exchange chromatography, such as DEAE sepharose, hydrophobic interaction chromatography, such as phenyl sepharose, or the combination thereof.

Also provided are isolated polynucleotides encoding the polypeptides described herein. For instance, a polynucleotide may have a nucleotide sequence encoding a polypeptide having the amino acid sequence shown in SEQ ID NOs:1-17, and an example of the class of nucleotide sequences encoding each polypeptide is disclosed herein as a coding region of Genbank accession NC_009440. It should be understood that a polynucleotide encoding a polypeptide represented by one of the sequences disclosed herein, e.g., SEQ ID NOs:1-17, is not limited to the nucleotide sequence disclosed as a coding region of Genbank accession NC_009440, but also includes the class of polynucleotides encoding such polypeptides as a result of the degeneracy of the genetic code. The class of nucleotide sequences encoding a selected polypeptide sequence is large but finite, and the nucleotide sequence of each member of the class may be readily determined by one skilled in the art by reference to the standard genetic code, wherein different nucleotide triplets (codons) are known to encode the same amino acid.

A polynucleotide disclosed herein can be present in a vector. A vector is a replicating polynucleotide, such as a plasmid, phage, or cosmid, to which another polynucleotide may be attached so as to bring about the replication of the attached polynucleotide. Construction of vectors containing a polynucleotide of the invention may employ standard ligation techniques known in the art. See, e.g., (Sambrook et al., 1989. Molecular cloning: a laboratory manual, 2nd ed. Cold Spring Harbor Laboratory Press, Cold Spring Harbor, N.Y.). A vector can provide for further cloning (amplification of the polynucleotide), i.e., a cloning vector, or for expression of the polynucleotide, i.e., an expression vector. The term vector includes, but is not limited to, plasmid vectors, viral vectors, cosmid vectors, and artificial chromosome vectors. Preferably the vector is a plasmid.

Selection of a vector depends upon a variety of desired characteristics in the resulting construct, such as a selection marker, vector replication rate, and the like. Vectors can be introduced into a host cell using methods that are known and used routinely by the skilled person. The vector may replicate separately from the chromosome present in the microbe, or the polynucleotide may be integrated into a chromosome of the microbe. When more than one vector is to be used in a cell, vectors having compatible origins of replication may be used (Adams et al. (US Patent Application 20110020875).

An expression vector may optionally include a promoter that results in expression of an operably linked coding regino during growth in anaerobic conditions. Promoters act as regulatory signals that bind RNA polymerase in a cell to initiate transcription of a downstream (3' direction) coding region. The promoter is operably linked to a coding region, and the coding region may encode an exogenous polypeptide or an endogenous polypeptide. In one embodiment, a promoter is operably linked to more than one coding region, encoding exogenous polypeptides, endogenous polypeptides, or a combination thereof. Such an arrangement of one promoter controlling expression of two or more operably linked coding regions is often referred to as an operon. In one embodiment, a exogenous promoter may be present in the genomic DNA and operably linked to an endogenous coding region.

In one embodiment, a suitable promoter causes expression of an operably linked coding region at temperatures of at least 30° C., at least 40° C., at least 50° C., at least 60° C., at least 70° C., at least 80° C., at least 90° C., or up at 100° C. In one embodiment, a suitable promoter causes expression of an operably linked coding region at temperatures between 30° C. and 100° C., between 50° C. and 90° C., or between 60° C. and 80° C.

In one embodiment, a promoter is one that functions in an archaeon, e.g., a promoter that is recognized by a highly conserved transcription complex present in archaea cells. Archaeal promoters do not have the same structure as promoters present in members of the domain Bacteria. One transcription factor important in the transcription of archaeal coding regions is TFB, a homologue of the eukaryotic TFIIB. Archaeal promoters often include a TATA box which may be centered 24 to 28 nucleotides upstream of a transcription start site, and the TATA box can be represented as a conserved 8 base pair sequence element TTTAWAta, where W is A or T, and R is A or G. An archaeal promoter may also include a TFB responsive element (cRNaANt), where R is A or G, and N is any nucleotide upstream and adjacent to the TATA box (Gregor and Pfeifer, 2005, Microbiology, 151:25-33; Bell et al., 1999, Mol. Cell., 4:971-982; Bell et al., 1999, PNAS USA, 96:13662-13667).

In one embodiment, a promoter is one that functions in a member of the domain Bacteria. The characteristics of bacterial promoters are known to the person skilled in the art, and include, for instance, a −10 element and a −35 element. A consensus sequence for the −10 element is TATAAT, and a consensus sequence for the −35 element is TTGACA; however, these consensus sequences are often not present in a promoter. Instead, a −10 element and a −35 element of a bacterial promoter often has only three or four of the six nucleotides in an element that match the consensus. Some bacterial promoters may also include an UP element, located upstream of the −35 element. Bacterial promoters are recognized by bacterial RNA polymerase, and are not recognized by a native RNA polymerase normally produced by an archaeon. Bacterial RNA polymerase includes 5 subunits, including a sigma subunit. Bacterial promoters having a −10 element and a −35 element as described above are recognized by an RNA polymerase that includes a sigma-70 subunit.

In those embodiments where a bacterial promoter is present in a genetically engineered archaeon, the genetically engineered archaeon requires a bacterial RNA polymerase to drive expression of a coding region operably linked to the bacterial promoter. Thus, a genetically engineered archaeon containing a bacterial promoter on an exogenous polynucleotide also includes coding regions encoding the subunits of an RNA polymerase that will recognize and bind to a bacterial promoter and result in expression of a coding region operably linked to the bacterial promoter. A bacterial promoter and the coding regions encoding the RNA polymerase subunits may be on the same exogenous polynucleotide or may be on separate exogenous polynucleotides in a genetically engineered archaeon. Coding regions encoding RNA polymerase subunits present on an exogenous polynucleotide present in a genetically engineered archaeon are operably linked to a promoter described herein, such as a temperature sensitive promoter or a constitutive promoter that functions in an archaeon.

The promoter useful in methods described herein may be, but is not limited to, a constitutive promoter, a temperature sensitive promoter, a non-regulated promoter, or an inducible promoter. A constitutive promoter drives expression of an operably linked coding region in a microbe when cultured at the temperatures described herein. The expression of a coding region operably linked to a constitutive promoter occurs at both high and low incubation temperatures, and the level of expression does not change substantially when expression at higher and lower incubation temperatures is compared. An example of a constitutive promoter is $P_{slp}$, a *P. furiosus* promoter of the highly expressed S-layer protein (Chandrayan et al., 2012. J. Biol. Chem., 287:3257-3264). Other examples of constitutive promoters include $P_{gdh}$, $P_{pep}$ and $P_{por\gamma}$, which are promoters in both *P. furiosus* and *T. kodakarensis* of the highly expressed glutamate dehydrogenase, phosphoenolpyruvate synthase and pyruvate ferredoxin oxidoredutase subunit γ, respectively (for example, see Lipscomb et al. 2011. Appl. Environ. Microbiol. 77:2232-2238; Chandrayan et al., 2012. J. Biol. Chem., 287:3257-3264).

The promoter may be a temperature sensitive promoter. In one embodiment, a temperature sensitive promoter drives expression of an operably linked coding region in a microbe at a greater level during incubation at low temperatures when compared to expression during incubation at high temperature. Such a promoter is referred to herein as a "cold shock" promoter. A cold shock promoter is induced at temperatures lower than the optimum growth temperature ($T_{opt}$) of a microbe. In one embodiment, a cold shock promoter is induced when a microbe is cultured at a temperature of no greater than 75° C., no greater than 70° C., no greater than 65° C., no greater than 60° C., no greater than 55° C., no greater than 50° C., no greater than 45° C., no greater than 40° C., or no greater than 35° C. In one embodiment, a cold shock promoter is induced when a microbe is cultured at a temperature between 35° C. and 45° C., between 40° C. and 50° C., between 45° C. and 55° C., between 50° C. and 60° C., between 55° C. and 65° C., between 60° C. and 70° C., or between 65° C. and 75° C. Induction of a cold shock promoter in a genetically engineered microbe may result in an upregulation of expression of an operably linked coding region by at least 10-fold, at least 15-fold, at least 20-fold, at least 25-fold, or at least 30-fold compared to expression of the same operably linked coding region during growth of the genetically engineered microbe at its $T_{opt}$.

Examples of cold shock promoters include those operably linked to the coding regions of *P. furiosus* described by Weinberg et al., (2005, J. Bacteriol., 187:336-348). A promoter is present in the region immediately upstream of the first codon of a coding region. In one embodiment, at least 150 nucleotides upstream to at least 200 nucleotides upstream of the first codon of the operably linked coding region includes the promoter. The size of the region that includes a promoter may be limited by the presence of an upstream coding region such as a start codon (for a coding region on the opposite strand) or a stop codon (for a coding region on the same strand). Identifying promoters in microbes, including hyperthermophilic archaeae and theiniophilic archaeae, is routine (see, for example, Lipscomb et al., 2009, Mol. Microbiol., 71:332-349). Other archaea contain homologues of the coding regions described by Weinberg et al., and the promoters of such homologues can be evaluated for induced expression at lower temperatures. Cold sock promoters may be produced using recombinant techniques.

In one embodiment, a temperature sensitive promoter drives expression of an operably linked coding region in a microbe at a decreased level during incubation at low temperatures when compared to expression during incubation at high temperature. Such a promoter is referred to herein as a "cold repressed" promoter. As described herein, a genetically engineered microbe may be used to produce a product; however, the microbe may normally produce an endogenous enzyme that uses the product or an intermediate leading to the product. The use of a cold repressed promoter is advantageous in such an embodiment. The genetically engineered microbe may be modified to decrease the production of the endogenous enzyme. For instance, a microbe may be genetically engineered by removing the promoter driving expression of an endogenous enzyme and replacing it with a cold repressed promoter.

A cold repressed promoter is repressed at temperatures lower than the $T_{opt}$ of a microbe. In one embodiment, a cold repressed promoter is repressed when a microbe is cultured at a temperature of no greater than 75° C., no greater than 70° C., no greater than 65° C., no greater than 60° C., no greater than 55° C., no greater than 50° C., no greater than 45° C., no greater than 40° C., or no greater than 35° C. In one embodiment, a cold repressed promoter is induced when a microbe is cultured at a temperature between 35° C. and 45° C., between 40° C. and 50° C., between 45° C. and 55° C., between 50° C. and 60° C., between 55° C. and 65° C., between 60° C. and 70° C., or between 65° C. and 75° C. The use of a cold repressed promoter in a genetically engineered microbe may result in an down-regulation of expression of an operably linked coding region by at least 10-fold, at least 15-fold, at least 20-fold, at least 25-fold, or at least 30-fold compared to expression of the same operably linked coding region during growth of the genetically engineered microbe at its $T_{opt}$.

Cold repressed promoters present in hyperthermophilic archaea and thermophilic archaea can be easily identified using routine methods. For instance, DNA microarray analysis can be used to compare expression of coding regions in an archaeon, such as a hyperthermophile, grown at its $T_{opt}$ and the arhaeon hyperthermophile grown at a temperature below the $T_{opt}$. The temperature below the $T_{opt}$ may be, for instance, at least 20° C., at least 30° C., at least 40° C. below the $T_{opt}$. The decrease in expression may be a change of at least 5-fold, at least 10-fold, at least 15-fold, or at least 20-fold when comparing expression at the two temperatures. Examples of cold repressed promoters include, but are not limited to, the promoter upstream of the hypothetical polypeptide encoded by coding region PF0882 of *P. furiosus*, the promoter upstream of the polypeptide encoded by coding region PF0421 of *P. furiosus*, and the promoter upstream of the polypeptide encoded by coding region PF0198 of *P. furiosus* (Kelly et al., WO 2013/067326). The promoters of Kelly et al. may be used by attaching a coding region such that the first codon of the coding region is present immediately adjacent to and downstream of the nucleotide located at the 3' end. In one embodiment, a promoter includes at least 200 consecutive nucleotides, at least 250 consecutive nucleotides, at least 300 consecutive nucleotides, at least 350 consecutive nucleotides, or at least 400 consecutive nucleotides.

A vector may include a ribosome binding site (RBS) and a start site (e.g., the codon ATG) to initiate translation of the transcribed message to produce the polypeptide. Like other regulatory sequences, a RBS may be heterologous with respect to a host cell. When expressing an exogenous polynucleotide in *P. furiosus*, it was found that the RBS needed to be carefully considered to ensure expression. A consensus RBS that may be used in *P. furiosus* is TAGT GGAGGATA (SEQ ID NO:306), where the underlined portion of the consensus RBS is usually at nucleotide position −10 to −5 relative to the start codon of the operably linked coding region. Other examples of useful RBS sequences include, but are not limited to, GGTGATATGCA ATG (SEQ ID NO:307), GGAGGTGGAGAAAATG (SEQ ID NO:308), GGAGGTTTGAAGATG (SEQ ID NO:309), GGAGGTGTGGGAAAATG (SEQ ID NO:310), and GGAGGGGGTGAGAGAGATG (SEQ ID NO:311), where the predicted RBS is underlined and the first codon of an operably linked coding region is a double underlined ATG.

A vector may also include a termination sequence to end translation. A termination sequence is typically a codon for which there exists no corresponding aminoacetyl-tRNA, thus ending polypeptide synthesis. The polynucleotide used to transform the host cell can optionally further include a transcription termination sequence, and one example is AATCTTTTTTAG (SEQ ID NO:312).

A vector introduced into a host cell optionally includes one or more marker sequences, which typically encode a molecule that inactivates or otherwise detects or is detected by a compound in the growth medium. For example, the inclusion of a marker sequence may render the transformed cell resistant to an antibiotic, or it may confer compound-specific metabolism on the transformed cell. Examples of a marker sequence include, but are not limited to, sequences that confer resistance to kanamycin, ampicillin, chloramphenicol, tetracycline, streptomycin, and neomycin. Examples of nutritional markers useful with certain host cells, including extremophiles, are disclosed in Lipscomb et al. (US Published Patent Application 20120135411), and include, but are not limited to, a requirement for uracil, histidine, or agmatine.

Polynucleotides of the present invention may be obtained from microbes, or produced in vitro or in vivo. For instance, methods for in vitro synthesis include, but are not limited to, chemical synthesis with a conventional DNA/RNA synthesizer. Commercial suppliers of synthetic polynucleotides and reagents for such synthesis are well known.

Also disclosed herein are genetically engineered microbes that have exogenous polynucleotides encoding one or more of the polypeptides disclosed herein. Compared to a control microbe that is not genetically modified in the same way, a genetically engineered microbe exhibits production of 3-HP, 4-HB, acetyl-CoA, or another product, or exhibits increased production of 3-HP, 4-HB, acetyl-CoA, or another product. Accordingly, in one aspect of the invention a genetically engineered microbe may include one or more exogenous polynucleotides that encode one or more of the polypeptides described herein. Exogenous polynucleotides encoding the polypeptides may be present in the microbe as a vector or integrated into a chromosome. In one embodiment, a genetically engineered microbe can exhibit an increase in production of 3-HP, 4-HB, acetyl-CoA, or another product that at least 5%, 10%, 25%, 50%, 75%, 100%, 150%, or 200% greater than the production of 3-HP, 4-HB, acetyl-CoA, or another product by an appropriate control.

Examples of useful bacterial host cells include, but are not limited to, *Escherichia* (such as *Escherichia coli*), *Salmonella* (such as *Salmonella enterica*, *Salmonella typhi*, *Salmonella typhimurium*), a *Thermotoga* spp. (such as *T. maritima*), an *Aquifex* spp (such as *A. aeolicus*), photosynthetic organisms including cyanobacteria (e.g., a *Synechococcus* spp. such as *Synechococcus* sp. WH8102 or, e.g., a *Synechocystis* spp. such as *Synechocystis* PCC 6803) and photosynthetic bacteria (e.g., a *Rhodobacter* spp. such as *Rhodobacter sphaeroides*), a *Caldicellulosiruptor* spp., such as *C. bescii*, and the like. Examples of useful archaeal host cells include, but are not limited to members of the Order Thermococcales (including a member of the genus *Pyrococcus*, for instance *P. furiosus*, *P. abyssi*, or *P. horikoshii*, or a member of the genus *Thermococcus*, for instance, *T. kodakaraensis* or *T. onnurineus*), members of the Order Sulfolobales (including a member of the genus *Metallosphaera*, for instance, *M. sedula*), and members of the Order Thermotogales (including members of the genus *Thermotoga*, for instance, *T. maritima* or *T. neapolitana*).

A genetically engineered microbe having exogenous polynucleotides encoding one or more of the polypeptides disclosed herein optionally includes a source of electrons that can be used for the reduction of $CO_2$ and/or other intermediates in the 4-HB cycle. In one embodiment, a source of electrons is hydrogenase, which catalyzes the reversible interconversion of $H_2$, protons, and electrons. A genetically engineered microbe may naturally include a hydrogenase suitable for supplying reductant, and in one embodiment, such a genetically engineered microbe may express an endogenous hydrogenase polypeptide at an increased level or have altered activity. For instance, a genetically engineered microbe may include an altered regulatory sequence, where the altered regulatory sequence is operably linked to one or more coding regions encoding subunits of a hydrogenase polypeptide. In another example, an endogenous polynucleotide encoding a subunit of a hydrogenase polypeptide may include a mutation, such as a deletion, an insertion, a transition, a transversion, or a combination thereof, that alters a characteristic of the hydrogenase polypeptides, such as the activity. In those aspects where a genetically engineered microbe expresses an endogenous hydrogenase polypeptide at an increased level or having altered activity, the microbe is typically an archaea, such as *Pyrococcus* spp., such as *P. furiosus, P. abyssi*, and *P. horikoshii*, a *Thermococcus* spp., such as *T. kodakaraensis* and *T. onnurineus*, and the like. Methods for modifying genomic DNA sequences of thermophiles and hyperthermophiles are known (Lipscomb et al. (US Published Patent Application 20120135411).

In one embodiment, a genetically engineered microbe may include exogenous polypeptides encoding the subunits of a hydrogenase. In one embodiment, the hydrogenase may be an NADPH-dependent hydrogenase. Examples of hydrogenases and their expression in microbes are described in Adams et al. (US Patent Application 20110020875), and Chandrayan et al. (2012, J. Biol. Chem., 287(5):3257-3264). In one embodiment, a hydrogenase includes 4 subunits, alpha, beta, gamma, and delta. In one embodiment, a hydrogenase is 2 subunits, alpha and delta.

A genetically engineered microbe may include other modifications in addition to exogenous polynucleotides encoding one or more of the polypeptides disclosed herein, or expressing an endogenous hydrogenase polypeptide at an increased level or having altered activity. Such modifications may provide for increased production of electron donors used by a hydrogenase polypeptide, such as NADH or NADPH.

Also provided are methods for using the polypeptides described herein. In one embodiment, the methods include providing the polypeptides for subpathway 1, subpathway 2, subpathway 3, or a combination thereof. In one embodiment, a combination is subpathway 1 and subpathway 2. In one embodiment, a combination is subpathway 1, subpathway 2, and subpathway 3. In one embodiment, a combination is subpathway 2 and subpathway 3. In one embodiment, a combination is subpathway 1 and subpathway 3. The polypeptides are incubated under conditions suitable for producing desirable products such 3-HP, 4-HB, and/or other products. Optionally, the product is collected using methods routine and known in the art.

In one embodiment, a source of reductant is also provided. In one embodiment, a source of reductant is provided by use of a hydrogenase.

In one aspect, the polypeptides used in the methods are cell-free. For instance, the polypeptides are isolated, or optionally purified. The incubation conditions are typically anaerobic, and the temperature may be at least 60° C., at least 70° C., at least 80° C., or at least 90° C. The methods can be performed in any convenient manner. Thus, the reaction steps may be perfouned in a single reaction vessel. The process may be performed as a batch process or as a continuous process, with desired product and waste products being removed continuously and new raw materials being introduced.

In another embodiment, the polypeptides used in the methods are present in a genetically engineered microbial cell. The methods can include incubating the microbial cell under conditions suitable for the expression of the polypeptides. The microbial cell may be a bacterial cell, such as a gram negative, for instance, *E. coli*, a photosynthetic organism, for instance, *R. sphaeroides*, or it can be an archaeal cell, for instance, a member of the genera *Pyrococcus*, for instance *P. furiosus, P. abyssi*, or *P. horikoshii*, or a member of the genera *Thermococcus*, for instance, *T. kodakaraensis* or *T. onnurineus*. The incubation conditions are typically anaerobic, and the temperature may be at least 37° C., at least 60° C., at least 70° C., at least 80° C., or at least 90° C. The use of these conditions results in several advantages. Growth at high temperatures reduces the risk of contamination, as growth of most microbes is reduced, or non-existent. The use of anaerobic conditions reduces the risks inherent in processing compounds that can be used as fuels, such as combustion. Moreover, the hyperthermophiles like *Pyrococcus* and *Thermococcus* have genomes of reduced complexity, and encode fewer polypeptides. The reduced complexity results in a more streamlined metabolism with fewer intermediates and decreased metabolic diversity. Hence, there is a decreased likelihood that there will overlap between the metabolites and/or enzymes of the host with those in the engineered metabolic pathway.

The conditions used to incubate the microbial cell typically include substrates that can be used by a cell to produce a reductant, such as NADPH. In one embodiment, the conditions used to incubate the microbial cell can include $H_2$, which can be used by the hydrogenase polypeptide to convert NADP to NADPH. The methods can be performed using any convenient manner. For instance, methods for growing microbial cells to high densities are routine and known in the art, and include batch and continuous fermentation processes.

In one embodiment, the method includes initial growth at a higher temperature followed by a shift to a lower temperature. The shift to a lower temperature can result in greater activity of one or more of the polypeptides described herein. In one embodiment, the greater activity may be due to increased expression of a coding region encoding one or more of the polypeptides, as is the case when a coding region is operably linked to a temperature sensitive promoter. In one embodiment, the greater activity may be due to the shift to a temperature that is better tolerated by the one or more polypeptides. Further details on expression of desired polypeptides below a microbe's $T_{opt}$, and the production of desired products, are disclosed in Kelly et al. (WO 2013/067326).

The methods disclosed herein may be used to make 3-HP, 4-HB, and other products. The 4-HB cycle results in the production of acetyl CoA. Acetyl CoA is an ideal product as it represents an activated reduced C-2 unit that is of fundamental importance in conventional biosynthetic pathways. For example, acetyl CoA is the building block for the biosynthesis of fatty acids, polyisoprenoids and hydroxyacids (such as 3-HB), all of which are potential sources of alkane-based fuels and/or plastics. Thus, the 4-HB cycle can be used to directly generate a range of biofuels, including alkanes, biodiesel (fatty acid esters) and ethanol, as well as butanol. Moreover, when converted to pyruvate, for instance by reductive carboxylation, acetyl CoA can serve as the primary carbon and electron source for all known biofuels (Connor et al., 2009, Curr Opin Biotechnol 20:307-315, Lee et al., 2008, Curr Opin Biotechnol 19:556-63, Peralta-Yahya et al., Biotechnol J 5:147-62). Methods for converting acetyl CoA to pyruvate are known and routine. Likewise, methods for converting any compound produced by the 3-HP/4-HB cycle to other useful products are known and routine. Other products that may be produced using the methods disclosed herein include, but are not limited to, 1,4-butanediol, succinic acid, isopropanol, ethanol, diols, and organic acids such as lactic acid, acetic acid, formic acid, citric acid, oxalic acid, and uric acid. The synthesis of 3-HP, 4-HB, acetyl-CoA, and other products may be a starting material for the synthesis of other compounds.

A method for using a genetically engineered microbe may also include recovery of the product produced by the genetically engineered microbe. The method used for recovery depends upon the product, and methods for recovering products resulting from microbial pathways, including carbohydrate metabolism, are known to the skilled person and used routinely. For instance, when the product is ethanol, the ethanol may be distilled using conventional methods. For example, after fermentation the product, e.g., ethanol, may be separated from the fermented slurry. The slurry may be distilled to extract the ethanol, or the ethanol may be extracted from the fermented slurry by micro or membrane filtration techniques.

Also provided herein are methods for making a genetically engineered microbe. The method includes introducing into a microbe at least one polynucleotide. In one embodiment, the polynucleotide encodes a polypeptide described herein, so that the microbe produces 3-HP, 4-HB, acetyl-CoA, or another product. In one embodiment, the introduced polynucleotide modifies an endogenous polynucleotide such that expression of an endogenous polypeptide is increased, or the amino acid sequence of an endogenous polypeptide is altered. An example of altering the amino acid sequence of an endogenous polypeptide includes modifying the amino acid sequence encoded by coding sequence Msed_1353 in a *M. sedula* such that the amino acid at residue 424 is not the tryptophan present in a wild type Msed_1353, and is a different amino acid, such as glycine.

The present invention is illustrated by the following examples. It is to be understood that the particular examples, materials, amounts, and procedures are to be interpreted broadly in accordance with the scope and spirit of the invention as set forth herein.

EXAMPLE 1

*Metallosphaera sedula* is an extremely thermoacidophilic archaeon that grows heterotrophically on peptides, and chemolithoautotrophically on hydrogen, sulfur, or reduced metals as energy sources. During autotrophic growth, $CO_2$ is incorporated into cellular carbon via the 3-hydroxypropionate/4-hydroxybutyrate cycle (3HP/4HB). To date, all steps in the pathway have been connected to enzymes encoded in specific genes, except for the one responsible for ligation of coenzyme A (CoA) to 4-hydroxybutyrate (4HB). While several candidates for this step have been identified through bioinformatic analysis of the *M. sedula* genome, none have been shown to catalyze this biotransformation. Here, transcriptomic analysis of cells grown under strict $H_2$—$CO_2$ autotrophy uncovered two additional candidates, encoded in Msed_0406 and Msed_0394. Recombinant versions of these enzymes catalyzed the ligation of CoA to 4HB, with similar affinities for 4HB (Km values of 1.9 and 1.5 mM for Msed_0406 and Msed_0394, respectively), but with different rates (1.69 and 0.22 µmol×min×mg$^{-1}$ for Msed_0406 and Msed_0394, respectively). Neither Msed_0406 nor Msed_0394 have close homologs in other Sulfolobales, although low sequence similarity is not unusual for acyl-adenylate forming enzymes. The capacity for these two enzymes to use 4HB as a substrate may have arisen from simple modifications to acyl-adenylate forming enzymes. For example, a single-amino acid substitution (Trp424 to Gly) in the active site of the acetate/propionate synthetase (Msed_1353), an enzyme that is highly conserved among the Sulfolobales, changed its substrate specificity to include 4HB. The identification of the 4-HB CoA synthetase now completes the set of enzymes comprising the 3HP/4HB cycle.

Experimental Procedures

Figure 2:
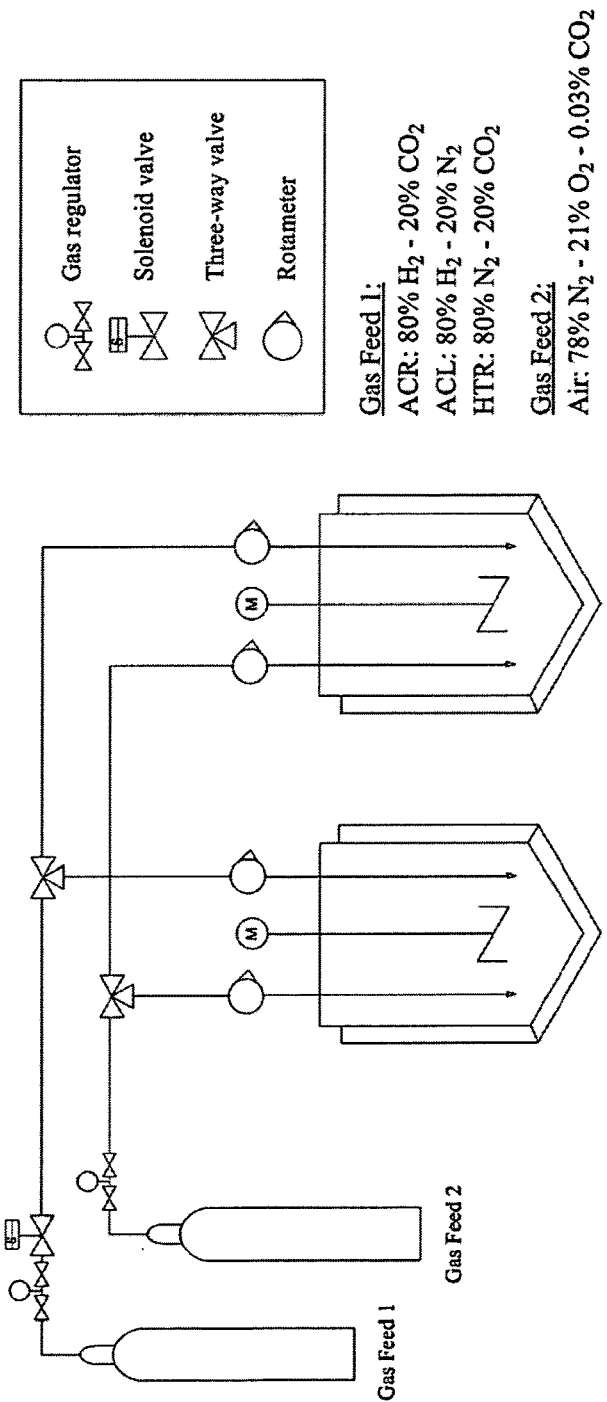
FIG. 2. Bioreactor schematic for gas intensive fermentation of *M. sedula*. Tandem 2 L bioreactors, started at the same time with the same seed inoculum, were used to grow *M. sedula* inside of a chemical fume hood. A solenoid valve on the $H_2/CO_2$ tank provided passive "fail-safe" operation by cutting off the flow of flammable gas in the event of food failure. Gas compositions for the three different conditions shown bottom right.

Growth of *M. sedula* in a gas intensive bioreactor—*M. sedula* (DSMZ 5348) was grown aerobically at 70° C. in a shaking oil bath (90 rpm) under autotrophic or heterotrophic conditions on DSMZ medium 88 at pH 2. Heterotrophically-grown cells were supplemented with 0.1% tryptone. Cell growth was scaled up from 300 ml in sealed one liter bottles (Auernik and Kelly, 2010, *Appl. Environ. Microbiol.* 76, 931-935) to 2 liters in a stirred bench-top glass feitnentor (Applikon), also on DSMZ medium 88 (pH 2) at 70° C., and agitated at 250 rpm. Two separately regulated gas feeds were used such that flow rates were held constant for all conditions at 1 ml/min for the hydrogen/$CO_2$ gas mixes (composition varied) and 100 ml/min for air (composition—78% $N_2$, 21% $O_2$, 0.03% $CO_2$). For the autotrophic, carbon-rich (ACR) condition, the gas feed contained $H_2$ (80%) and $CO_2$ (20%); for the autotrophic carbon-limited (ACL) condition the feed was changed to $H_2$ (80%) and $N_2$ (20%); for the heterotrophic condition (HTR), the medium was supplemented with 0.1% tryptone and the gas feed composition was $N_2$ (80%) and $CO_2$ (20%). Tandem fermentors were run simultaneously with the same inoculum to generate biological repeats (FIG. 2). Cells were harvested at mid-exponential phase by rapid cooling with dry ice and ethanol, and then centrifuged at 6,000×g for 15 min at 4° C.

*M. sedula* Oligonucleotide Microarray Transcriptional Response Analysis—A spotted whole-genome oligonucleotide microarray, based on 2,256 protein-coding open reading frames (ORFs), was used, as described previously (Auernik and Kelly, 2008, *Appl. Environ. Microbiol.* 74, 7723-7732). Total RNA was extracted and purified (RNeasy; Qiagen), reverse transcribed (Superscript III; Invitrogen), re-purified, labeled with either Cy3 or Cy5 dye (GE Healthcare), and hybridized to the microarray slides (Corning). Slides were scanned on a GenePix 4000B Microarray Scanner (Molecular Devices, Sunnyvale, Calif.), and raw intensities were quantitated using GenePix Pro v6.0. Normalization of data and statistical analysis were performed using JMP Genomics 5 (SAS, Cary, N.C.). In general, significant differential transcription was defined to be relative change at or above 2 (where a $\log_2$ value of ±1 equals a two-fold change) with significance values at or above the Bonferroni correction; for these data, this was 5.4 (equivalent to a p-value of $4.0 \times 10^6$). Microarray data are available through the NCBI Gene Expression Omnibus (GEO) under accession number GSE39944.

Enzyme assays for 4-Hydroxybutyrate-CoA synthetase—Two assays were used to measure ligase activity, one spectrophotometric and one using high-performance liquid chromatography (HPLC). A discontinuous assay was used to measure substrate-dependent disappearance of CoA at 75° C. The reaction mixture (600 µl) contained 100 mM MOPS-KOH (pH 7.9), 5 mM $MgCl_2$, 2.5 mM ATP, 0.15 mM CoA, and purified enzyme. At each time point, 80 µl of reaction mixture was added to 80 µl cold 5,5'-dithiobis-(2-nitrobenzoic acid) (DTNB). A time point (0 min) was taken before heating. The reaction mixture was incubated for 2 min at 75° C., followed by addition of substrate. Additional time points were taken at 30, 60, 90, 120, and 180 sec after addition of substrate. Absorbance was measured at 412 nm to determine free CoA concentration, based on the concentration of 2-nitro-5-thiobenzoate dianion (NTB$^{2-}$) ($\epsilon_{412}$=14,150 M$^{-1}$ cm$^{-1}$) (Hawkins et al., 2011, *ACS Catal.* 1, 1043-1050, Riddles et al., 1983, *Methods in Enzymology* 91, 49-60). Enzymes were kinetically characterized by varying the concentration of the acyl-CoA substrate from 0.05 mM to 12 mM, while the other substrate concentrations were held constant. Measurements for specific activity were taken under saturating substrate concentrations (10 mM). Formation of the CoA ester was also confirmed using HPLC (Waters). The reaction mixture (0.15 ml) contained 100 mM potassium phosphate (pH 7.9), 10 mM MgCl$_2$, 2 mM ATP, 0.5 mM CoA, 10 mM substrate, and purified enzyme. The reaction was incubated for 3 min at 75° C., quenched with 15 µl 1M HCl, filtered with a 10 kDa spin column (Amicon YM-10) to remove the protein, and loaded onto a reversed-phase C18 silica-based column (Shodex C18-4E, 4.6×250 mm). The mobile phase was 50 mM sodium phosphate buffer (pH 6.7) with 2% methanol.

Heterologous expression of *M. sedula* genes in *E. coli*—*M. sedula* genes encoding acyl-CoA synthetases were amplified from genomic DNA using primers synthesized by Integrated DNA Technologies (Coralville, Iowa). Msed_0394 and Msed_0406 were ligated into pET46-Ek/LIC, while Msed_1353 was ligated into pET21b using NdeI and XhoI restrictions sites. All constructs were designed to express with an N-terminal His$_6$-tag. Plasmids containing gene inserts were cloned into Novablue GigaSingles *E. coli* competent cells and selected by growth on LB-agar supplemented with ampicillin (100 µg/ml). Plasmid DNA was extracted using a QIAprep Spin Miniprep kit. Sequences were confirmed by Eton Biosciences, Inc. (Durham, N.C.). For protein expression, the plasmids were transformed into *E. coli* Rosetta 2 (DE3) cells and selected by growth on LB-agar, supplemented with ampicillin (100 µg/ml) and chloramphenicol (50 µg/ml). Cells harboring the recombinant plasmid were induced with IPTG (final concentration 0.1 mM) at OD$_{600}$ 0.4-0.6 and cultured for three hours before harvest.

Purification of recombinant proteins—Cells were harvested by centrifugation at 6,000×g for 15 min at 4° C. Cell yields ranged from 1.6-3.8 g cells per liter LB medium (wet weight). Cell pellets were re-suspended in lysis buffer (50 mM sodium phosphate, 100 mM NaCl, 0.1% NP.40, pH 8.0) containing DNase and lysozyme at final concentrations of 10 and 100 µg/ml, respectively. Cells were lysed with a French Press (two passes at 18,000 psi) and the lysate was centrifuged at 22,000×g for 15 min at 4° C. to removed insoluble material. Soluble, cell-free extract was heated to 65° C. for 20 min to precipitate mesophilic proteins. Streptomycin sulfate (1% w/v) was added to precipitate nucleic acids, followed by a one hour incubation at 4° C. A final centrifugation was performed at 22,000×g for 15 min at 4° C. to collect the soluble, heat-treated cell-free extract, which was sterile filtered (0.22 µm) and purified using a 5 ml HisTrap™ nickel column (GE Healthcare). Proteins were bound to the HisTrap™ column using binding buffer (50 mM sodium phosphate, 500 mM NaCl, 20 mM imidazole, pH 7.4) and eluted using elution buffer (50 mM sodium phosphate, 500 mM NaCl, 300 mM imidazole, pH 7.4). SDS-PAGE was then performed on the IMAC fractions to qualitatively determine the purity of the protein before further purification. Chromatography fractions containing the protein were concentrated and exchanged into phosphate buffer (50 mM potassium phosphate, 150 mM NaCl, pH 7.0) using an Amicon YM10 (Millipore) centrifugal filter membrane, centrifuged at 4000×g and 4° C. To quantify the amount of protein, a Bradford assay was performed on the concentrated IMAC fractions using known serial dilutions of bovine serum albumin (BSA) by taking absorbance readings at 595 nm. Protein was further purified using a Superdex 200 10/300 GL (GE Healthcare) gel filtration column. The proteins were eluted from the gel filtration column using elution buffer (50 mM potassium phosphate, 150 mM NaCl, pH 7.0). Proteins were dialyzed into 100 mM MOPS-KOH (pH 7.9) and either stored at 4° C. or mixed with glycerol to 20% and stored at −20° C.

Site-Directed Mutagenesis of Msed_1353—Msed_1353 was mutated with the GENEART® Site-directed mutagenesis system (Life Technologies), using AccuPrime™ Pfx polymerase. Mutagenesis primers were designed to change W424 to glycine (Primer 1—5'-CCCTTTGGTAGCACT-TGGGGAATGACTGAAACTGG (SEQ ID NO:312; Primer 2—reverse compliment of Primer 1). Plasmids with Msed_1353-G424 were cloned into Novablue GigaSingles *E. coli* competent cells and selected by growth on LB-agar supplemented with ampicillin (100 µg/ml). Sequences were confirmed by Eton Biosciences Inc (Durham, N.C.).

Structural modeling of Acyl-CoA synthetases—Three-dimensional structural models for *M. sedula* acyl-CoA synthetases were made using the iterative threading assembly refinement (I-TASSER) online server (Berg 2011, *Appl. Environ. Microbiol.* 77, 1925-1936, Berg et al., 2010, *Nat. Rev. Microbiol.* 8, 447-460, Roy et al., 2010, *Nat Protoc* 5, 725-738). The server first generates three-dimensional atomic models from multiple threading alignments and iterative structural assembly, and then infers function by structural matching to other known proteins. All structures were generated using the Protein Data Base entry for *S. enterica* Acs (STM4275, 1PG4) as a threading template for additional restraint specification. Amino acid sequence alignments were generated using the UCSF Chimera package by superposition of I-TASSER 3D structural models with the PDB structure for *S. enterica* Acs.

Materials—Plasmid vectors and strains were obtained from Novagen (San Diego, Calif.) and Stratagene (La Jolla, Calif.). Chemicals, devices, and reagents were obtained from Fisher Scientific (Pittsburgh, Pa.), ACROS Organics (Geel, Belgium), Sigma Chemical Co. (St. Louis, Mo.), New England Biolabs (Ipswich, Mass.), Qiagen (Valencia, Calif.), Millipore (Billerica, Mass.) and Invitrogen (Grand Island, N.Y.). Gases were purchased from Airgas National Welders (Charlotte, N.C.). Protein purification columns were obtained from GE Healthcare (Piscataway, N.J.). The Bradford Assay reagent was obtained from Bio-Rad (Hercules, Calif.). Site-directed mutagenesis kit was obtained from Invitrogen (Life Technologies).

Results

*Metallosphaera sedula* Autotrophic Growth is Hydrogen-Limited—In order to explore the optimal growth conditions for H$_2$—CO$_2$ autotrophy in *M. sedula*, a felinentation system was designed to allow controlled definition of the gas feed. Previous autotrophic work with *M. sedula* was done in batch cultures in an orbital shaking bath at 70° C. (Berg, 2011, *Appl. Environ. Microbiol.* 77:1925-1936, Berg et al., 2007, *Science*, 318:1782-1786, Alber et al., 2008, *J. Bacteriol.* 190:1383-1389, Hugler et al., 2003, *Arch. Microbiol.* 179:160-173, Auernik and Kelly, 2010, *Appl. Environ. Microbiol.*, 76:931-935). In that case, gas-fed cultures were grown by replacing the air in a sealed volume with a gaseous mixture of a known composition. Mass transfer of H$_2$, CO$_2$, and O$_2$ into the culture medium was limited to diffusion across the vapor-liquid interface. Gas limitation presumably affected these cultures, and led to sub-optimal growth, as evidenced by the slow doubling time that resulted for *M. sedula* under these conditions ($t_d$=11 to 13 h).

In order to grow *M. sedula* autotrophically with more optimal delivery of gaseous substrate to the liquid medium, a semi-continuous fermentation system was developed using a 3 L bioreactor. The system was modified to have two separate gas feeds that sparged directly into the media (sparging stone—2 μm pore size). Microbubble sparging stones were used to promote dissolution of sparingly soluble gases, in particular $H_2$. The bioreactor and console were situated inside a modified fume hood, with an airflow monitoring system in place to detect hood failure. Tandem fermentors were seeded with the same inoculum and run simultaneously to provide a biological repeat.

Growth of *M. sedula* in an aerobic, autotrophic fermentation system was expected to be $H_2$-, and not $O_2$-limited. Below saturating conditions, growth rates varied according to the amount of $H_2$ fed to the culture. For high $H_2$ supply rates (i.e., 30 ml/min), the growth rates were comparable to the fastest growth rates previously observed under heterotrophy ($t_d$=4.8 h); concomitantly, the culture reached a cell density of $2\times10^9$ cells/ml. the highest observed under autotrophic conditions. At a $H_2$ supply rate of 15 ml/min, the growth rate slowed ($t_d$=6 h) although the final density was comparable to the 30 ml/min case ($1.5\times10^9$ cells/nil). A 30-fold reduction in $H_2$ flow rates (1 ml/min) caused the growth rate to decrease by half ($t_d$=9.7 h) and the cells to enter stationary phase at $8\times10^8$ cells/ml.

A similar trend emerged in response to limiting levels of $CO_2$. When $CO_2$ was supplemented in the gas feed (referred to here as "rich" autotrophy), the growth rate was faster that observed for cells grown with air as the only source of $CO_2$ ($t_d$=6.8 h vs. 9.4 h, respectively). The growth rate for heterotrophically grown cells ($t_d$=6.7 h) was comparable to the "rich" autotrophy condition. This suggests that, under the "rich" autotrophy condition, the cells were not limited by any one particular gaseous substrate and were doubling at or near their maximal rate. The decrease in growth rate for the carbon-limited autotrophy arises from the limiting amounts of $CO_2$ available in the medium.

Optimized $H_2$—$CO_2$ autotrophy conditions lED to enhanced transcriptomic response—The optimized autotrophic growth conditions enhanced the global transcriptional response compared to previous work (Berg et al., 2007, Science, 318:1782-1786, Huber et al., 2008, Proceedings of the National Academy of Sciences, U.S.A, 105:7851-7856, Auernik and Kelly, 2010, Appl. Environ. Microbiol., 76:931-935). Of the 2293 protein coding genes in the 2.2 kb *M. sedula* genome, nearly half (984 genes) exhibited changes in transcription (either up- or down-regulation) of two-fold or greater, when comparing heterotrophy (HTR) to the autotrophic carbon-limited (ACL) condition (See Table 2). The number of genes that were differentially transcribed was twice as high as previously observed (Berg et al., 2010, Nat. Rev. Microbiol. 8:447-460, Auernik and Kelly, 2010, Appl. Environ. Microbiol., 76:931-935), which could be attributed to the refined conditions for autotrophic growth. Also, in the experiments reported here, it should be mentioned that the improved sensitivity of new equipment used for scanning microarray slides improved the resolution and dynamic response.

TABLE 2

Enhanced Transcription Response for *M. sedula* Autotrophy

|  | ACL-ACR | ACL-HTR | ACR-HTR | A-H (1) |
|---|---|---|---|---|
| # of genes UP-regulated (2-fold or more) | 52 | 467 | 433 | 229 |
| # of genes DOWN-regulated (2-fold or more) | 124 | 517 | 464 | 252 |

(1) Auernik and Kelly, 2010, *Appl. Environ. Microbiol.* 76: 931-935

Overall, the global transcriptional changes were extensive. Transcripts for the characteristic enzymes of the 3HP/4HB pathway were significantly up-regulated on ACL-HTR. For example, the genes encoding α- and β-subunits of acetyl-CoA/propionyl-CoA carboxylase (Msed_0147-0148), were up-regulated 18- and 29-fold, respectively, while the 4-hydroxybutyryl-CoA dehydratase gene (Msed_1321), was up-regulated 27-fold. Hydrogenases and hydrogenase assembly and maturation proteins in both the cytosolic hydrogenase operon (Msed_0921-0933) and the membrane-bound hydrogenase operon (Msed_0947-0950) were both highly up-regulated on ACL-HTR, from 3- to 47-fold higher.

New candidates for 4-hydroxybutyrate-CoA synthetase identified from refined transcriptomic data—The refined transcriptomic data provided new insights into the putative candidates for 4-hydroxybutyrate-CoA synthetase (FIG. 3). Based on bioinformatic analysis, there are nine candidate genes encoding acyl-CoA synthetases (not including Msed_1456, which was confirmed as a 3HP-CoA synthetase). The high up-regulation of Msed_1422 under autotrophy (13-fold increase) that was observed in this work is consistent with previous transcriptomic studies. On the basis of that initial study, Msed_1422 was chosen for recombinant expression and testing (Berg, 2011, Appl. Environ. Microbiol. 77:1925-1936, Ramos-Vera et al., 2011, J. Bacteriol. 193:1201-1211, Estelmann et al., 2011, J. Bacteriol. 193: 1191-1200). In the same study recombinant forms of Msed_1291 and Msed_1353 were also produced, which were chosen based on homology to a confirmed 4HB-CoA synthetase from *Thermoproteus neutrophilus* (Tneu_0420). None of these enzymes showed activity on 4HB. Msed_1422 and Msed_1291 showed no activity on acetate, propionate, 3HP, 3HB, 4HB, or crotonate, and Msed_1353 had activity only on acetate and propionate, but not 4HB. Thus, it appears that Msed_1353 is a promiscuous acetate/propionate synthetase, while the substrate specificities of Msed_1422 and Msed_1291 remain unknown.

Among the other potential candidates that were annotated as acetate-CoA synthetases or medium-chain fatty acid-CoA synthetases (FIG. 3), most showed no transcriptional response, had average or low levels of transcription, or were clearly down-regulated under autotrophy. The new transcriptomic data were consistent with the expression of two previously unexamined candidates, Msed_0406 and Msed_0394, which are annotated as an acetyl-CoA synthetase (ACS) and AMP-dependent synthetase and ligase, respectively. Although Msed_0406 and Msed_0394 were both constitutively transcribed, with less than a two-fold change in transcription levels between the conditions tested, both of them were in the top 25% of the transcriptome. This served as the basis to investigate these two genes by recombinant expression and activity assays, given that no other promising candidates for this step had emerged.

Figure 4:
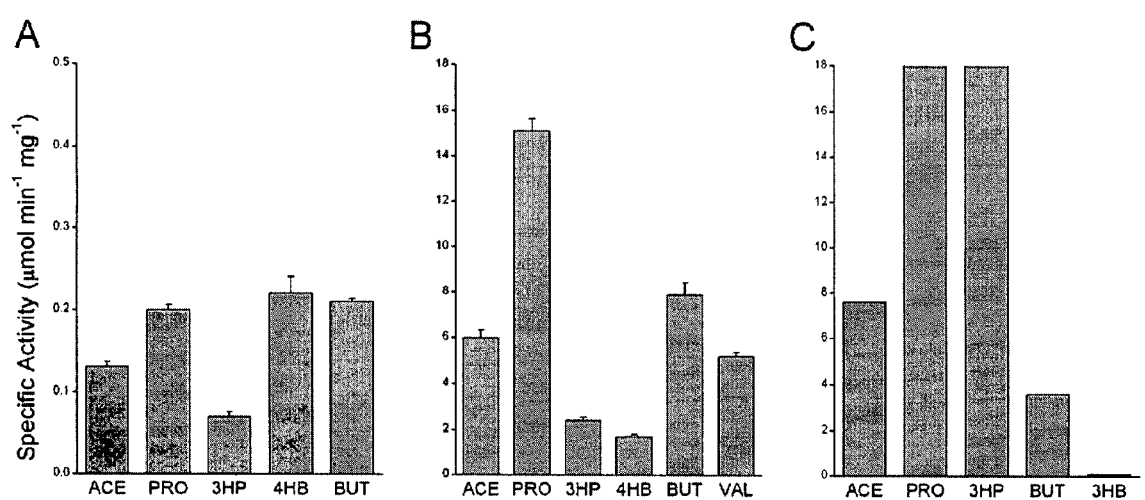
FIG. 4. Specific activity of acyl-CoA ligases in the *M. sedula* carbon fixation pathway on various substrates. Specific activities of the new candidates for 4-hydroxybutyrate-CoA ligase on a variety of substrates compared to reported data for Msed_1456, a 3-hydroxypropionate-CoA ligase: Msed_0394 (A), Msed_0406 (B), and Msed_1456 (C). Msed_1456 showed >1% activity on 3-hydroxybutyrate, but was not tested on 4-hydroxybutyrate. Substrate abbreviations: ACE—acetate; PRO—propionate; 3HP—3-hydroxypropionate; 4HB—4-hydroxybutyrate; BUT—butyrate; VAL—valerate.
Figure 9:
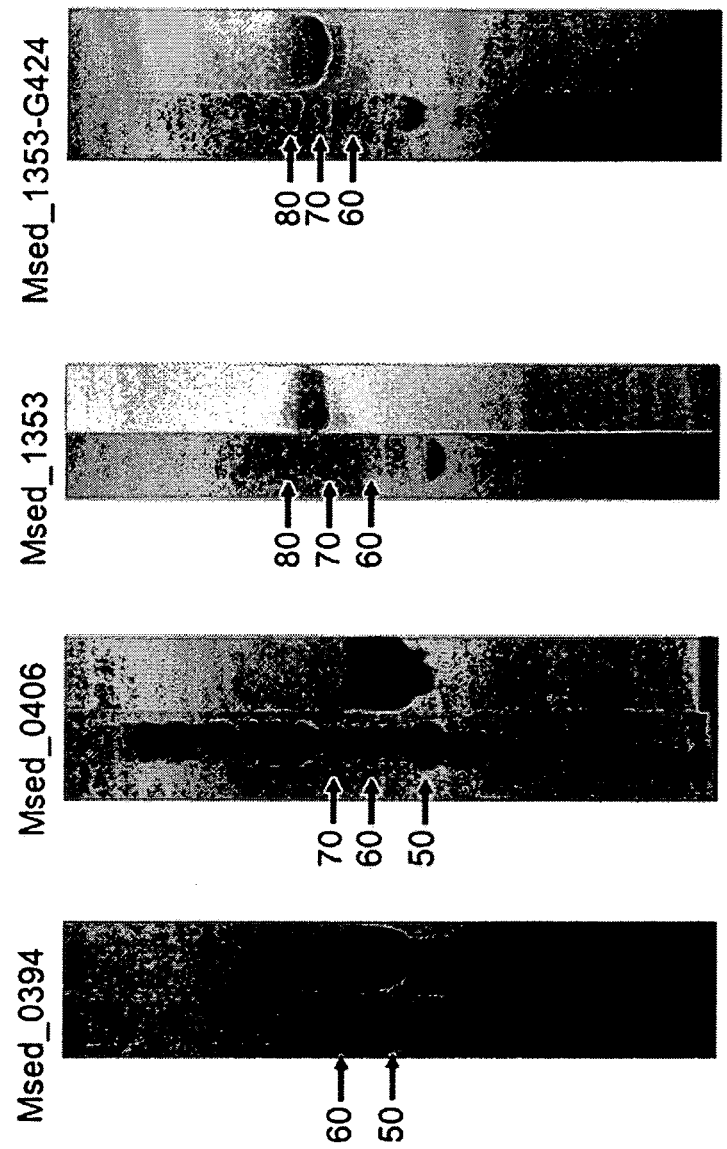
FIG. 9. SDS-PAGE gel images of purified recombinant enzymes. All samples were run on 4-12% NuPAGE® Bis-Tris Mini Gels (Life Technologies). BenchMark™ Protein Ladder (Invitrogen) was used for molecular weight reference.
Figure 10:
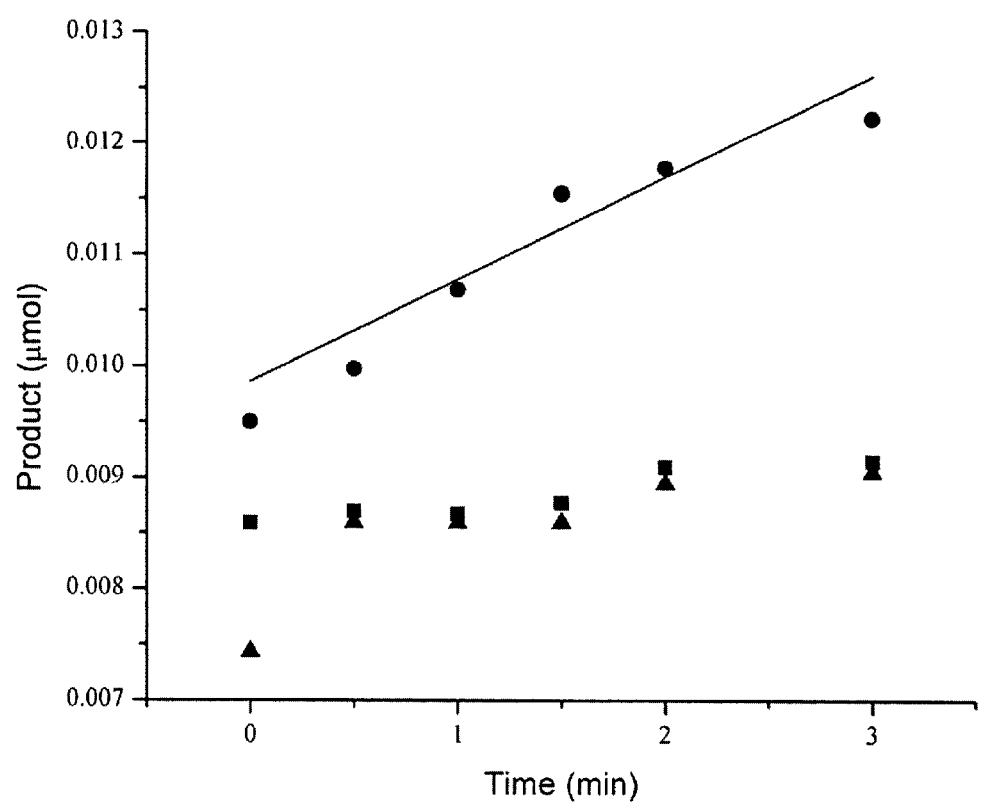
FIG. 10. Progress curve for Msed_0406 on 4HB with controls. Example reaction progress curve showing how data were generated for kinetic characterization. Initial reaction rate was taken as the slope of the linear region on the progress curve for a given substrate concentration (5 mM 4HB—circles). Two negative controls are shown: no 4HB (squares) and no ATP (triangles). A series of reaction rates was graphed over substrate concentration and a non-linear fitting was used to calculate Michaelis-Menten parameters.

Kinetic Analyses of Msed_0394 and Msed_0406—Recombinant forms of Msed_0394 and Msed_0406 were produced in *E. coli* and purified to electrophoretic homogeneity (see FIG. 9 for SDS-PAGE gels). For both enzymes, the production of 4HB-CoA from 4HB and CoA was confirmed using reversed-phase HPLC. Msed_0394 and Msed_0406 were active on a range of small organic acids (see Table 3 for a summary of kinetic data). FIG. 4 shows the relative specific activities on different substrates for Msed_0394, Msed_0406, along with reported data for 3HP-CoA synthetase (Msed_1456) for comparison (Berg et al., 2007, Science, 318:1782-1786, Alber et al., 2008, J. Bacteriol. 190:1383-1389, Estelmann et al., 2011, J. Bacteriol. 193:1191-1200. Note that the calculated molecular weight for these three enzymes varies slightly—62 kDa for Msed_0394, 64 kDa for Msed_0406, and 74 kDa for Msed_1456; these specific activities here are meant to highlight substrate preference patterns for each enzyme.

TABLE 3

Enzyme kinetic data for CoA synthetases from *M. sedula*

| Enzyme | Substrate | $K_m$ ($\mu$M) | $V_{max}$ ($\mu$mol min$^{-1}$ mg$^{-1}$) | $k_{cat}$ (s$^{-1}$) | $k_{cat}/K_m$ (s$^{-1}$ M$^{-1}$) |
|---|---|---|---|---|---|
| Msed_0394 | Acetate | 680 | 0.13 | 0.14 | 200 |
|  | Propionate | 540 | 0.2 | 0.21 | 390 |
|  | 3-Hydroxypropionate | 1880 | 0.07 | 0.08 | 40 |
|  | 4-Hydroxybutyrate | 1540 | 0.22 | 0.24 | 160 |
|  | Butyrate | 60 | 0.21 | 0.23 | 3700 |
|  | Valerate | 120 | 0.2 | 0.22 | 2000 |
| Msed_0406 | Acetate | 2030 | 6.0 | 6.4 | 3200 |
|  | Propionate | 380 | 15.1 | 16.2 | 43000 |
|  | 3-Hydroxypropionate | 810 | 2.4 | 2.6 | 3200 |
|  | 4-Hydroxybutyrate | 2000 | 1.7 | 1.8 | 910 |
|  | Butyrate | 320 | 7.9 | 8.4 | 26000 |
|  | Valerate | 740 | 5.2 | 5.6 | 7500 |
| Msed_1353-G424 | 4-Hydroxybutyrate | 1130 | 2.3 | 2.5 | 2180 |

The specific activities for Msed_0394 show little difference in the maximum reaction rate under saturating substrate concentrations for the different substrates. The highest reaction rate observed was ~0.2 $\mu$mol min$^{-1}$ mg$^{-1}$ for propionate, 4HB, and butyrate. However if the substrate specificities are taken into account a different picture emerges. A comparison of the catalytic specificity constants ($k_{cat}/K_m$) for each substrate tested with Msed_0394 (Table 3) shows that the highest value is for butyrate (3700 M$^{-1}$ s$^{-1}$), followed by valerate (2000 M$^{-1}$ s$^{-1}$), propionate (390 M$^{-1}$ s$^{-1}$), acetate (200 M$^{-1}$ s$^{-1}$), and finally 4HB (160 M$^{-1}$ s$^{-1}$). There is a clear preference for unsubstituted straight chain organic acids with chain length of four or five carbons. No activity was detected with the six carbon hexanoic acid.

The specific activities for Msed_0406 under saturating substrate concentrations show the highest reaction rates for propionate (15.1 $\mu$mol min$^{-1}$ mg$^{-1}$). The catalytic specificity constant profile for Msed_0406 shows that this enzyme works best on propionate (43000 M$^{-1}$ s$^{-1}$), then butyrate (26000 M$^{-1}$ s$^{-1}$), valerate (7500 M$^{-1}$ s$^{-1}$), acetate/3HP (3200 M$^{-1}$ s$^{-1}$), and then 4HB (910 M$^{-1}$ s$^{-1}$). The high $V_{max}$ for acetate/propionate, combined with the low for propionate, suggest that Msed_0406 is also a promiscuous acetate/propionate ligase, although one that also shows activity on 4HB.

Site-Directed Mutagenesis of Msed_1353—Msed_1353, a highly conserved gene among the Sulfolobales, was previously reported to have activity only on acetate and propionate (Berg et al., 2007, Science, 318:1782-1786, Alber et al., 2008, J. Bacteriol. 190:1383-1389, Ramos-Vera et al., 2011, J. Bacteriol. 193:1201-1211, Hagler et al., 2003, Eur. J. Biochem. 270:736-744, Alber et al., 2006, J. Bacteriol. 188:8551-8559, Auernik et al., 2008, Appl. Environ. Microbiol. 74:7723-7732). Initial efforts to identify the unknown 4HB-CoA synthetase in *M. sedula* involved purification of native enzyme activity and analysis of multiple SDS-PAGE gel bands using mass spectrometry. Msed_1353 was detected in these experiments and, based on the very large up-regulation of Msed_1353 under autotrophy, it was recombinantly produced to confirm its activity. Our results confirmed previous reports: under saturating substrate concentrations Msed_1353 had highest activity on acetate (8.9 $\mu$mol min$^{-1}$ mg$^{-1}$—100%) and propionate (99%), but also on 3HP (8%) and butyrate (16%). However, no activity was found on 4HB or longer organic acid substrates (see FIG. 5A).

Structural modeling of the binding pocket of Msed_1353 revealed a conserved tryptophan residue, similar to that seen in acetate-CoA synthetase (ACS) from *S. enterica* (Berg et al., 2007, Science, 318:1782-1786, Riddles et al., 1983, Methods M Enzymology 91:49-60, Gulick et al., 2003, Biochemistry 42:2866-2873). This tryptophan forms the bottom surface of the binding pocket and limits the size of substrate that can be accommodated within the active site. To test the importance of this residue in determining substrate specificity, Trp$^{424}$ in Msed_1353 was mutated to a glycine to produce Msed_1353-G424. The single substitution mutant (Trp$^{424}$→Gly)) was predicted to contain a larger interior binding pocket for the hydrophobic end of the substrate. Accordingly, it showed a dramatic change in specificity (FIG. 5B). Activity for the mutant on acetate and propionate decreased by 60%, from 8.9 to 3.6 and 8.8 to 3.5 $\mu$mol min$^{-1}$ mg$^{-1}$, respectively. However, Msed_1353-G424 also showed activity on C4-C8 substrates, including 4HB (1.8 $\mu$mol min$^{-1}$ mg$^{-1}$).

Figure 6:
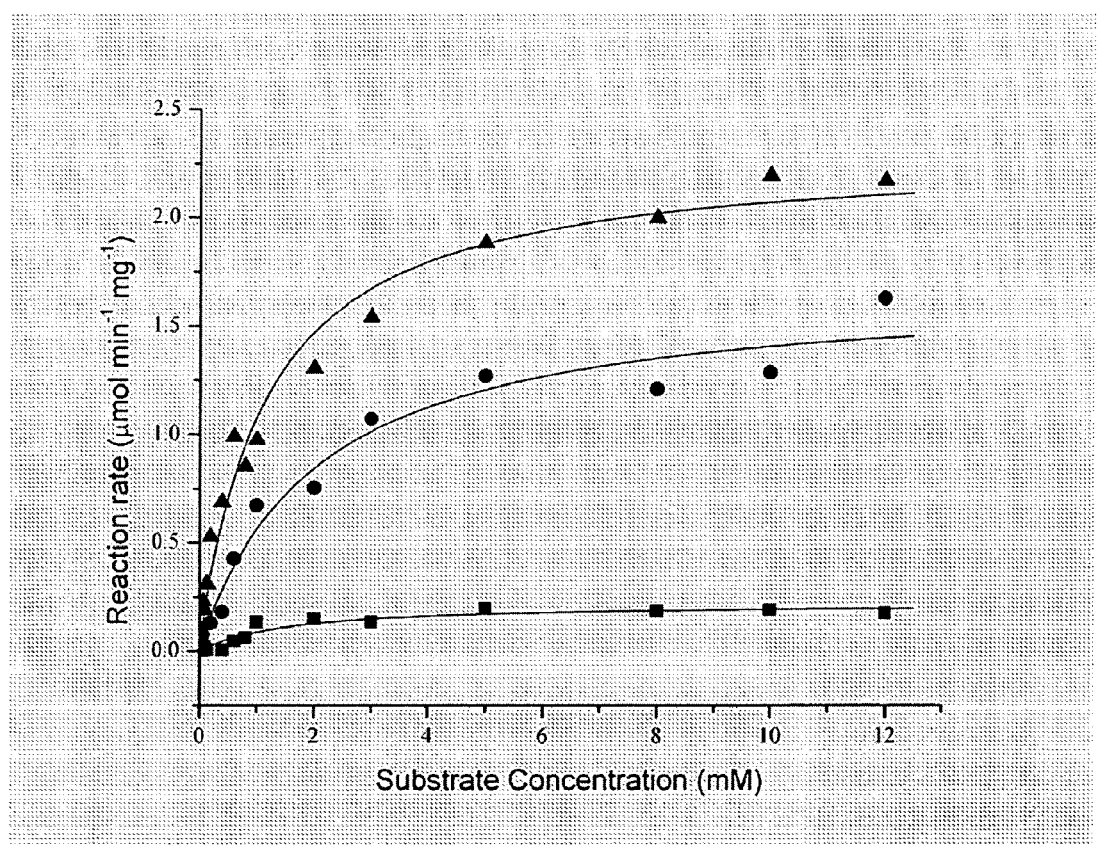
FIG. 6. Reaction rate profile for acyl-CoA ligases. Michaelis-Menten reaction rate curves shown with experimental data for Msed_0394 (squares), Msed_0406 (circles), and Msed_1353-G424 (triangles) over a range of substrate concentrations.

In order to compare the activity of these three enzymes on 4HB the Michaelis-Menten curves are shown in FIG. 6. From this figure it is clear that there is a large difference in catalytic rate for the three enzymes, and this difference holds over the entire range of substrate concentration, including when $[S]/K_m \ll 1$. Therefore although it is possible that both Msed_0394 and Msed_0406 are catalytically active on 4HB in vivo, it is likely that Msed_0406 is more physiologically relevant in terms of catalytic performance. Additionally, the single point mutation of Msed_1353 to Msed_1353-G424 produces an enzyme that is active on 4HB at even higher rates for all substrate concentrations.

Discussion

The semi-continuous gas-intensive bioreactor system developed here was successfully used to refine the transcriptional response of autotrophy-related genes in *M. sedula*. This system provided better delivery of sparingly soluble gases and allowed more precise regulation of gas composition than could be achieved in serum bottles. At 70° C. and 1 atm, the solubility of oxygen and hydrogen are comparable (0.6 mM), while the solubility of carbon dioxide is about 20-fold higher (12 mM) (Auernik and Kelly, 2010, Appl. Environ. Microbiol., 76:931-935, Ramos-Vera et al., 2011, J. Bacteriol., 193:1201-1211, Wilhelm et al., 1977, Chem. Rev., 77:219-262). For these experiments, the low solubility of $H_2$ was offset by the use of microbubbler sparing stones (2 $\mu$m pore size) to increase the gas phase surface area and increase delivery of $H_2$ to the medium.

Stoichiometrically, at least four $H_2$ molecules are required for every carbon atom fixed. Assuming that ATP generation requires the oxidation of two hydrogen molecules, then each turn of the cycle requires 12 molecules of hydrogen for every two molecules of carbon dioxide. As such, the limiting growth factor for *M. sedula* in a bioreactor is likely acquisition of the electron donor, in contrast to most aerobic microbial fermentation where acquisition of the final electron acceptor, oxygen, limits growth. In its natural environment, the picture may be somewhat different. Hydrogen measurements from the (largely anoxic) acidic hot springs at Yellowstone indicate that gaseous hydrogen may be quite abundant—with concentrations ranging between 10-300 nM (Auernik and Kelly, 2010, Appl. Environ. Microbiol., 76:931-935, Spear et al., 2005, Proc. Natl. Acad. Sci. U.S.A. 102:2555-2560). The source of this hydrogen gas is primarily geochemical; although the mechanism is not well understood, it probably arises from subsurface interaction of water with Fe[II] (Auernik et al., 2008, Appl. Environ. Microbiol. 74:7723-7732, Sleep, 2004, Proc. Natl. Acad. Sci. U.S.A. 101:12818-12823). For most subsurface environments, oxygen is probably limiting (Gold, 1992, Proc. Natl. Acad. Sci. U.S.A. 89:6045-6049). However, *M. sedula* was isolated from aerobic (surface) samples of a hot water pond at Pisciarelli Solfatara (Huber et al., 1989, Syst. Appl. Microbiol. 12:38-47). Thus both hydrogen and oxygen may be available in abundance for autotrophic growth.

The regulation of growth modes in *M. sedula* involves massive transcriptional changes between heterotrophic and autotrophic growth. Nearly half the genome (984 genes out of 2293) responded with transcriptional changes of 2-fold or greater when comparing heterotrophy to carbon dioxide limited autotrophy. Not much is known about the regulation strategies employed by archaea to control gene transcription, but between different forms of chemolithoautotrophy (reduced metals, $H_2$, etc.) and heterotrophy, *M. sedula* can utilize a broad range of metabolic substrates for growth.

The missing step in the 3HP/4HB pathway has been the acyl-CoA synthetase that utilizes 4HB. Previous attempts to identify the gene that encodes this enzyme were unsuccessful, and the candidate enzymes had no activity on 4HB (Ramos-Vera et al., 2011, J. Bacteriol. 193:1201-1211). In this work, two previously unexamined synthetases from *M. sedula*, consistent with the new transcriptomic evidence, were recombinantly produced and characterized. Both Msed_0394 and Msed_0406 showed activity on 4HB as well as other small organic acids. Based on the lack of other synthetase candidates suggested by the transcriptomic analysis and previous biochemical evidence ruling out Msed_1422 and Msed_1291, we conclude that one or both of these enzymes are necessary for autotrophic growth in *M. sedula*.

Acetyl-CoA synthetases belong to the Class I superfamily of adenylate-forming enzymes that includes acyl- and aryl-CoA synthetases, the adenylation domains of non-ribosomal peptide synthetases (NRPSs), and firefly luciferase (Schmelz and Naismith, 2009, Current Opinion in Structural Biology 19:666-671). These enzymes use a two-step mechanism in which first an acyl-AMP intermediate is formed (with release of pyrophosphate) followed by displacement of AMP by CoA (Gulick, 2009, ACS chemical biology 4:811-827). Most acetyl-CoA synthetases have a limited substrate range. Archaeal acyl-CoA synthetases, which form a phylogenetic cluster distinct from other bacterial subgroups (Brasen et al., 2005, Extremophiles 9:355-365), have been reported to exhibit broader substrate preferences. The acetyl-CoA synthetase from *Pyrobaculum aerophilum* can work on acetate, propionate, butyrate, and isobutyrate (Brasen et al., 2005, FEBS Lett. 579:477-482); another acetyl-CoA synthetase from *Archaeoglobus fulgidus* was active on acetate, propionate, and butyrate (Ingram-Smith and Smith, 2007, Archaea 2:95-107). Both Msed_0394 and Msed_0406 were found to have activity on a broad range of small organic acid substrates of up to five carbons in length.

Activity of both purified Msed_0394 and Msed_0406 on 4HB was well above the reported activity measured in autotrophic cell extract (0.3 µmol min$^{-1}$ mg$^{-1}$) (Berg et al., 2007, Science, 318:1782-1786). It appears that Msed_0406 is primarily a promiscuous propionate-CoA synthetase. Msed_0394, by contrast, has nearly equal levels of activity on acetate, propionate, and 4-HB. Although the overall activity for Msed_0394 is lower by comparison, when taking into account the different substrate specificities, this enzyme shows a preference for C5-C6 linear unsubstituted organic acids. By comparison, the homologous 4-HB-CoA synthetase from *Thermoproteus neutrophilus* (Tneu 0420), an anaerobic archaeon that contains the DC/4HB carbon fixation cycle, was recombinantly produced and shown to have maximal activity on 4HB, followed by crotonate, acetate, 3HP, and 3HB (Ramos-Vera et al., 2011, J. Bacteriol. 193:1201-1211). The reported $K_m$ for Tneu_0420 is about 3-fold lower than that found for Msed_0406 (700 µM vs. 2000 µM), with comparable activity (1.6 vs. 1.8 µmol min$^{-1}$ mg$^{-1}$), which suggests that the catalytic activities on 4HB are also comparable.

It is likely that Msed_0406 is more effective at catalyzing the ligation of CoA to 4HB in vivo than Msed_0394. Perhaps these enzymes have evolved from highly specific acetate/propionate synthetases to be sufficient for catalyzing the necessary reaction on 4HB for the 3HP/4HB fixation cycle. It is not clear why two synthetases would be required, or if both of them are necessary for autotrophic growth. However, they are so far the only ligases in *M. sedula* that have been shown to activate 4HB with CoA.

Genes with high homology to Msed_0394 and Msed_0406 exist in the genome of the closely related *M. cuprina* (67% and 73% amino acid identity, respectively), but it is less clear whether homologs exist in the genomes of other Sulfolobales, such as the *Sulfolobus* and *Acidianus* spp. Members of the acyl-adenylate forming enzyme family may share little identity or similarity in amino acid sequence apart from a few highly conserved core motifs (Ingram-Smith and Smith, 2007, Archaea 2:95-107). There are homologs of Msed_0406 in other species of Sulfolobales that have 30-35% identity, and one homolog in *S. acidocaldarius* with 61% identity. But the effort to find the *M. sedula* 4HB-CoA synthetase has shown that substrate specificity cannot be inferred from amino acid sequence homology alone. However, the low homology of the *M. sedula* 4HB-CoA synthetase gene does stand out among all the other genes in the 3HP/4HB cycle, which have distinct homologs in *Sulfolobus* spp. that range from 50-80% identity.

Since 4HB is a metabolite unique to butyrate metabolism (Pryde et al., 2002, FEMS Microbiol. Lett. 217:133-139), including γ-aminobutyrate fermentation (Gerhardt et al., 2000, Arch. Microbiol. 174:189-199) and polyhydroxyalkanoate production (Valentin et al., 1995, Eur. J. Biochem. 227:43-60), it is unlikely to have any other role in crenarchaeal metabolism outside of carbon fixation. Recent work with metabolic flux analysis has shown there is another exit route for carbon flux from the cycle through succinyl-CoA to succinate (Estelmann et al., 2011, *J. Bacteria* 193:1191-1200). In this study the authors estimate that two-thirds of the cycle carbon flux passes to succinate via succinyl-CoA or succinic semialdehyde, while one-third of the cycle carbon flux passes through the latter part of the cycle (via 4HB) to regenerate acetyl-CoA. Of course, this flux distribution may be highly dependent on growth conditions and could shift more to the 4HB branch depending on substrate availability.

It is clear that all members of the Sulfolobales order have a homolog for 4hbd, and therefore should have a complete set of enzymes for carbon fixation. But, previous studies have been mixed as to which *Sulfolobus* spp. are capable of autotrophic growth. Early reports on *Sulfolobus acidocaldarius* isolates claimed that they could grow chemolithoautotrophically on elemental sulfur (Brock et al., 1972, Arch. Microbiol. 84:5/1 68, Shivvers and Brock, 1973, J. Bacteriol. 114:706-710). Subsequent reports claim that neither *S. solfataricus* nor *S. acidocaldarius* can grow autotrophically on elemental sulfur alone (Grogan, 1989, J. Bacteriol. 171: 6710-6719), although it is unclear whether they simply lost the ability to grow chemolithoautotrophically or were selected from what were originally mixed cultures (Kletzin et al., 2004, J. Bioenergetics and Biomembranes 36:77-91). Recent reports have shown autotrophic growth of *S. metallicus* on sulfur and *S. tokodaii* on both sulfur and iron (Bathe et al., 2007, Appl. Environ. Microbiol. 73:2491-2497). The only other member of the Sulfolobales that has been reported to grow on hydrogen is *Acidianus ambivalens*, a sulfur-reducing acidophile (Laska, 2003, Microbiol. 149: 2357-2371). Genes encoding for hydrogenase and maturation enzymes with homology to *M. sedula* hydrogenase genes are present in one strain of *S. islandicus* (HVE10/4), but this is predicted to be involved in anaerobic fermentation (Guo et al., 2011, J. Bacteriol. 193:1672-1680). Clearly, some *Sulfolobus* spp. must have a functional carbon fixation pathway, but others seem to possess an incomplete or non-functional pathway. It may be that the CoA-activating ligase that can operate on 4HB is essential for complete cycle function, and loss of 4HB-CoA synthetase activity renders the carbon fixation cycle inoperable.

Figure 7:
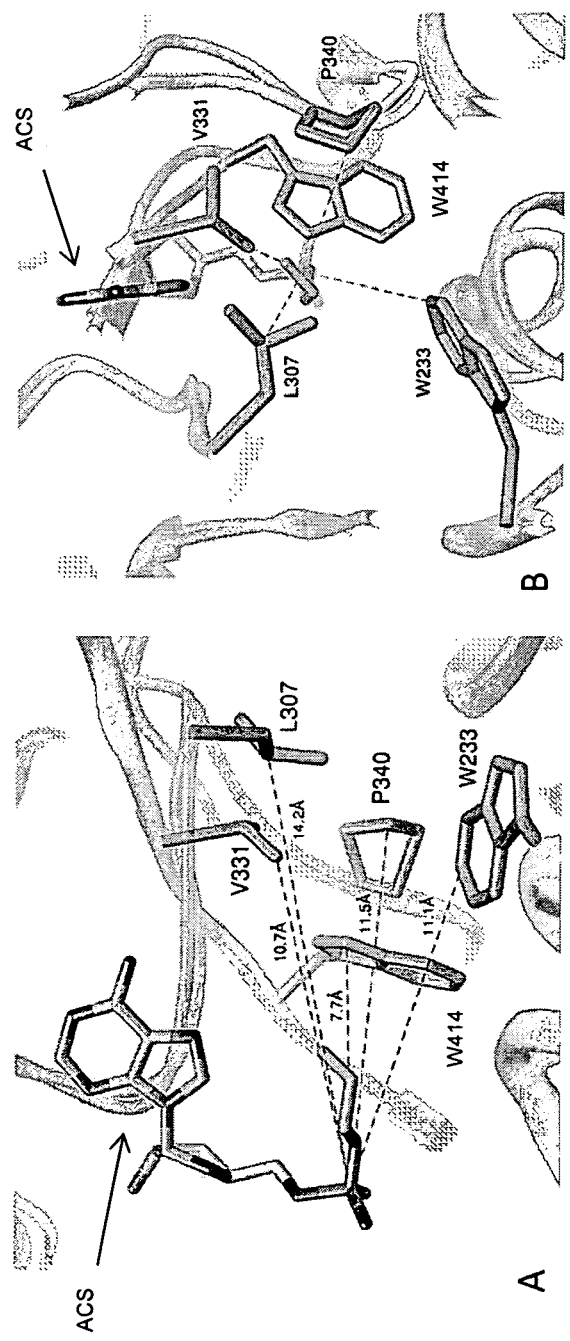
FIG. 7. *S. enterica* acetyl-CoA synthetase (Acs) and Msed_0394 active site comparison. Acs shown in gold (residue W414), Msed_0394 in cyan (residues W233, L307, V331, and P340). Ligand from Acs structure (adenosine-5'-propyl phosphate) is labeled Acs. A) Side view of binding pocket with inter-atomic distances given from phosphorus atom of propyl-phosphate moiety to select atom from amino acid residues. B) Axial view from bottom of substrate binding pocket.

To investigate the issue of substrate specificity, de novo structural predictions of *M. sedula* acyl-CoA synthetases with crystal structures were compared with other known synthetases, including acetyl-CoA synthetase from both *S. enterica* (Gulick et al., 2003, Biochemistry 42:2866-2873) and *S. cerevisiae* (Jogl and Tong, 2004, Biochemistry 43:1425-1431), and 4-chlorobenzonate-CoA synthetase from *Alcaligenes* sp. (Gulick et al., 2004, Biochemistry 43:8670-8679). The structure for ACS from *S. enterica* revealed that there are four residues that form the acetate binding pocket—$Val^{310}$, $Thr^{311}$, $Val^{386}$, and $Trp^{414}$ (Gulick et al., 2003, Biochemistry 42:2866-2873). The conserved tryptophan residue cuts the binding pocket short and precludes activity on longer substrates (FIG. 7). Extensive mutagenesis of binding pocket residues in yeast ACS showed that mutation of $Trp^{416} \rightarrow Gly^{416}$ was sufficient to lengthen the binding pocket to accommodate C4-C8 organic acids (Ingram-Smith et al., 2006, Biochemistry 45:11482-11490). Amino acid sequence alignments show that Msed_1353 has a tryptophan in the same position ($Trp^{424}$) (FIG. 8) and should, therefore, only work on acetate and propionate, a fact that has been confirmed biochemically (Ramos-Vera et al., 2011, J. Bacteriol. 193:1201-1211). Here, there was some activity with Msed_1353 on 3HP and butyrate, but no activity on 4HB. Msed_0394 and Msed_0406 both have a glycine in this position, G333 and G346, respectively. However, the rest of the genes annotated as acyl-CoA synthetases in *M. sedula* also have a glycine in this position, so this glycine residue alone is not sufficient to indicate activity on C3-05 unsubstituted linear organic acids. Both Msed_1422 and Msed_1291 were recombinantly expressed and showed to be inactive on C2-C4 linear organic acids (Ramos-Vera et al., 2011, J. Bacteriol. 193: 1201-1211).

Figure 5:
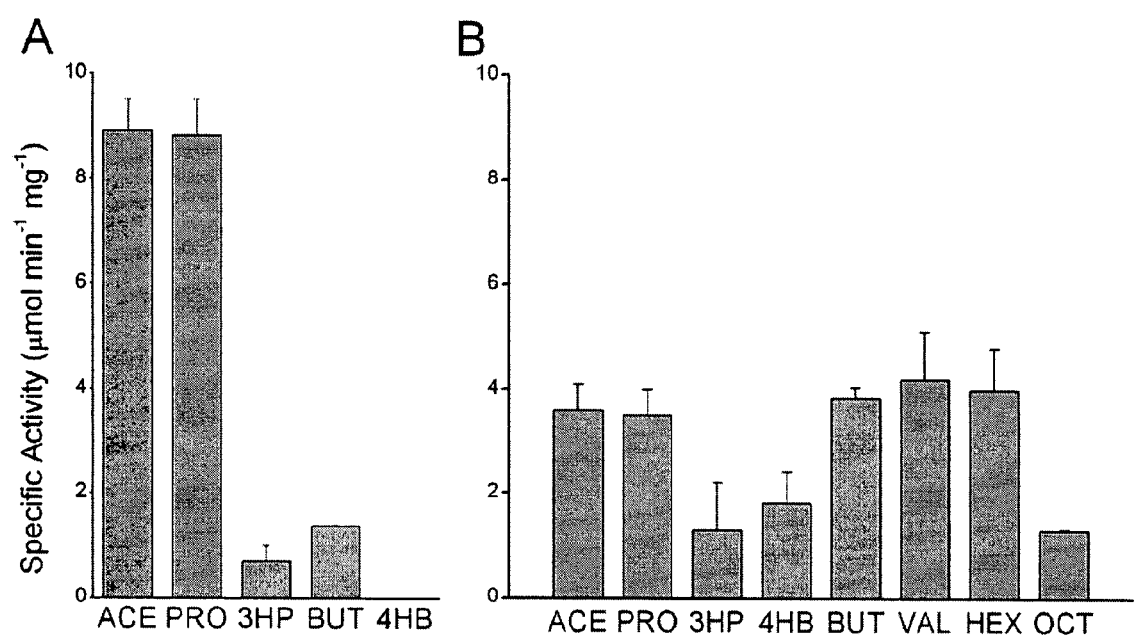
FIG. 5. Specific activity of native Msed_1353 and Msed_1353-W424G mutant on various substrates. Comparison of activity of Msed_1353 (A) and Msed_1353-G424 (B) on a variety of short-chain linear organic acids. Substrate abbreviations: ACE—acetate; PRO—propionate; 3HP—3-hydroxypropionate; 4HB—4-hydroxybutyrate; BUT—butyrate; VAL—valerate; HEX—hexanoate; OCT—octanoate.

A mutant of Msed_1353 with a glycine in place of the conserved tryptophan ($Trp^{424} \rightarrow Gly$) was made by site directed mutagenesis and expressed in *E. coli* (Msed_1353-G424). The native enzyme was active only on acetate and propionate, but the mutant showed activity on 3HP, 4HB, valerate, hexanoate, and even octanoate (FIG. 5). The activity was just as high on C5-C8 substrates as on acetate and propionate, but lower on 3HP and 4HB. This suggests that the polar hydroxyl group destabilizes the interaction between the substrate and the residues of the enlarged binding pocket. A similar trend is evident with Msed_0406 (FIG. 4). However, Msed_0394 has nearly equal levels of activity on propionate, butyrate, and 4HB, suggesting that it can stabilize the hydroxyl group on 4HB better than that of 3HP. Similarly, Msed_1456, which catalyzes the ligation of CoA to 3HP in the 3HP/4HB pathway, has equal activity on propionate and 3HP, and therefore might have residues in the active site that help stabilize the hydroxyl group of 3HP.

In Msed_1456, $Val^{386}$, which makes contacts with the γ-carbon of the propyl moiety in the *S. enterica* ACS structure, is replaced with $Asn^{390}$, whose polar amide nitrogen could hydrogen bond with the hydroxyl group of 3HP to stabilize substrate binding. As for Msed_0406, both valine residues in the acetate binding pocket are replaced with alanine ($Ala^{249}$ and $Ala^{321}$) and $Thr^{311}$ is replaced with a lysine ($Lys^{250}$). In Msed_0394, all three of these residues are alanine ($Ala^{240}$, $Ala^{241}$, and $Ala^{309}$). Potential candidate residues for stabilizing the hydroxyl group of 4HB in Msed_0394 include $His^{341}$ and $Tyr^{338}$.

This work helps to close the gaps on the missing piece of the 3HP/4HB pathway in *M. sedula*. It is still unclear why only certain members of the Sulfolobales operate the 3HP-4HB cycle, but this may reflect the environmental history of specific species. Furthermore, along with other recent successes obtaining recombinant versions of difficult to produce enzymes from the pathway (Han et al., 2012, *Appl. Environ. Microbiol.*, 78:6194-202), complete characterization of all cycle enzymes is near at hand. The information obtained for cycle function will be invaluable for the creation of a metabolically engineered platform capable of producing of chemicals and fuels from carbon dioxide (Hawkins et al., 2011, ACS Catal. 1:1043-1050).

EXAMPLE 2

Production of an Industrial Chemical Using Hydrogen and Carbon Dioxide

Microorganisms can be engineered to produce useful products, including chemicals and fuels from sugars derived from renewable feedstocks, such as plant biomass. An alternative method is to utilize low potential reducing power from non-biomass sources, such as hydrogen gas or electricity, to reduce carbon dioxide directly into products. This approach circumvents the overall low efficiency of photosynthesis and the production of sugar intermediates. While significant advances have been made in manipulating microorganisms to produce useful products from organic substrates, engineering them to utilize carbon dioxide and hydrogen gas has not been reported. Herein, we describe a novel temperature-dependent approach that confers upon a microorganism, the archaeon *Pyrococcus furiosus*, that grows optimally on carbohydrates at 100° C., the capacity to utilize carbon dioxide, a reaction that it does not accomplish naturally. This was achieved by the heterologous expression of five genes of the carbon fixation cycle of the archaeon *Metallsphaera sedula*, which grows autotrophically at 73° C. The engineered *P. furiosus* strain is able to utilize hydrogen gas and incorporate carbon dioxide into 3-hydroxypropionic acid, one of the top twelve industrial chemicals building blocks. The reaction can be accomplished by cell-free extracts and by whole cells of the recombinant *P. furiosus* strain. Moreover, it is carried out some 30° C. below the optimal growth temperature of the organism, conditions that support only minimal growth but maintain sufficient metabolic activity to sustain the production of 3-hydroxypropionate. The approach described here can be expanded to produce important organic chemicals, all through biological activation of carbon dioxide.

Materials and Methods

Figure 11:
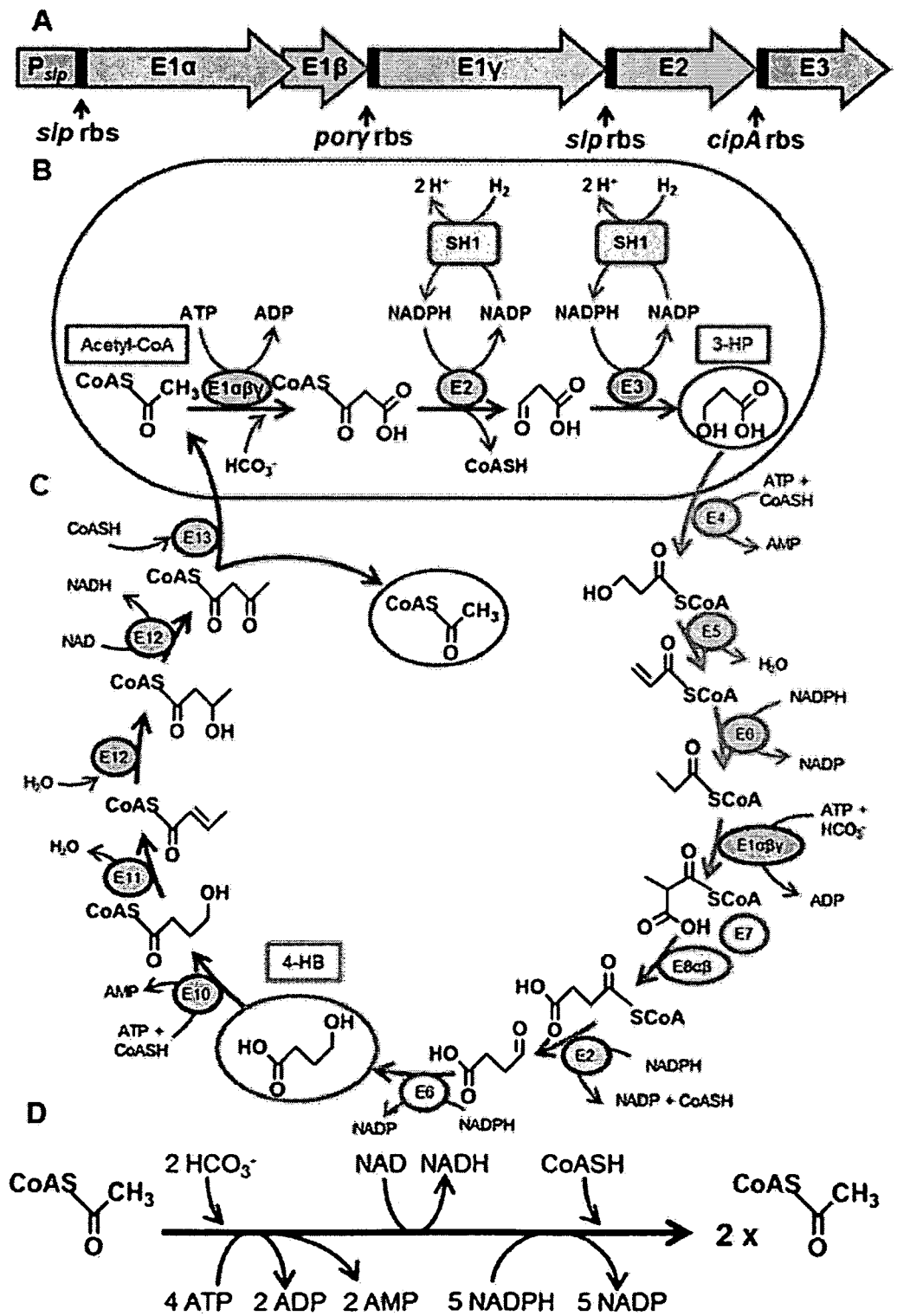
FIG. 11. (A) The synthetic operon constructed to express the M. sedula genes encoding E1 ($\alpha\beta\gamma$), E2 and E3 in P. furiosus under the control of the promoter for the S-layer protein gene ($P_{slp}$). This includes P. furiosus ribosomal binding sites (rbs) from highly-expressed genes encoding pyruvate ferredoxin oxidoreductase subunit $\gamma$ (por$\gamma$, PF0971), the S-layer protein (slp, PF1399) and cold-induced protein A (cipA, PF0190). (B) The first three enzymes of the M. sedula 3-HP/4-HB cycle produce the key intermediate 3-hydroxypropionate (3-HP). E1 is acetyl/propionyl-CoA carboxylase ($\alpha\beta\gamma$, encoded by Msed_0147, Msed_0148, Msed_1375): E2 is malonyl/succinyl-CoA reductase (Msed_0709) and E3 is malonate semialdehyde reductase (Msed_1993). NADPH is generated by P. furiosus soluble hydrogenase I (SH1), which reduces NADP with hydrogen gas. (C) The first three enzymes (E1-E3) are shown in context of the complete 3-HP/4-HP cycle for carbon dioxide fixation by Metallosphaera sedula showing the three subpathways SP1, SP2, and SP3. (D) The horizontal scheme shows the amount of energy (ATP), reductant (NADPH), oxidant (NAD) and CoASH required to generate one mole of acetyl-CoA from two moles of carbon dioxide.

Construction of a synthetic SP1 operon. PCR was performed using *P. furiosus* or *M. sedula* genomic DNA to generate the individual PCR products of the *P. furiosus* S-layer promoter ($P_{slp}$) and the five *M. sedula* SP1 genes, consisting of coupled E1αβ (Msed_0147-Msed_0148), E1γ (Msed_1375), E2 (Msed_0709) and E3 (Msed_1993). *P. furiosus* ribosomal binding sites, consisting of 11-14 bp of sequence upstream of highly-expressed proteins, were added in front of E1γ (5'-GGAGGTTTGAAG (SEQ ID NO:313), sequence upstream from porγ, PF0791), E2 (5'-GGGAG-GTGGAGCAT (SEQ ID NO:314), sequence upstream from slp, PF1399), and E3 (5'-GGTGATATGCA (SEQ ID NO:315), sequence upstream from cipA, PF0190). The primer sequences are given in Table 4. SOE-PCR (splicing by overlap extension and PCR, (Horton et at, 1989, *Gene* 77(1):61-68) was performed to combine the individual PCR products and generate the expression cassette for SP1 (FIG. 11A).

TABLE 4

Primers used in the construction of the synthetic SP1 operon.

| Primer target | Direction | 5' to 3' sequence |
| --- | --- | --- |
| $P_{slp}$ | Forward | GAATCCCCGCGGCCCGG GCTGGCAGAATAGAA (SEQ ID NO: 316) |
| | Reverse | GCAACCAAAACTCTACT AAAGGGTGGCATTTTTC TCCACCTCCCAATAATC TG (SEQ ID NO: 317) |
| Msed_0147-0148 | Forward | ATGCCACCCTTTAGTAG AGTTTTGG (SEQ ID NO: 318) |
| | Reverse | GTTGCAGTCATCTTCAA ACCTCCTTACTTTATCA CCACTAGGATATCTCC (SEQ ID NO: 319) |
| Msed1375 | Forward | GTGATAAAGTAAGGAGG TTTGAAGATGACTGCAA CTTTTGAAAAACCGGAT (SEQ ID NO: 320) |
| | Reverse | CGTTCTCCTCATATGCT CCACCTCCCTTAGAGGG GTATATTTCCATGCTTC (SEQ ID NO: 321) |
| Msed_0709 | Forward | GGCAATGTCATATGAGG AGAACGCTAAAGGCCGC AATTC (SEQ ID NO: 403) |

TABLE 4-continued

Primers used in the construction of the synthetic SP1 operon.

| Primer target | Direction | 5' to 3' sequence |
| --- | --- | --- |
| | Reverse | CCTTTTCAGTCATTGCA TATCACCTCATCTCTTG TCTATGTAGCCCTTC (SEQ ID NO: 322) |
| Msed_1993 | Forward | TAGACAAGAGATGAGGT GATATGCAATGACTGAA AAGGTATCTGTAGTTGG AG (SEQ ID NO: 323) |
| | Reverse | CCAATGCATGCTTATTT TTCCCAAACTAGTTTGT ATACCTTC (SEQ ID NO: 324) |

Figure 14:
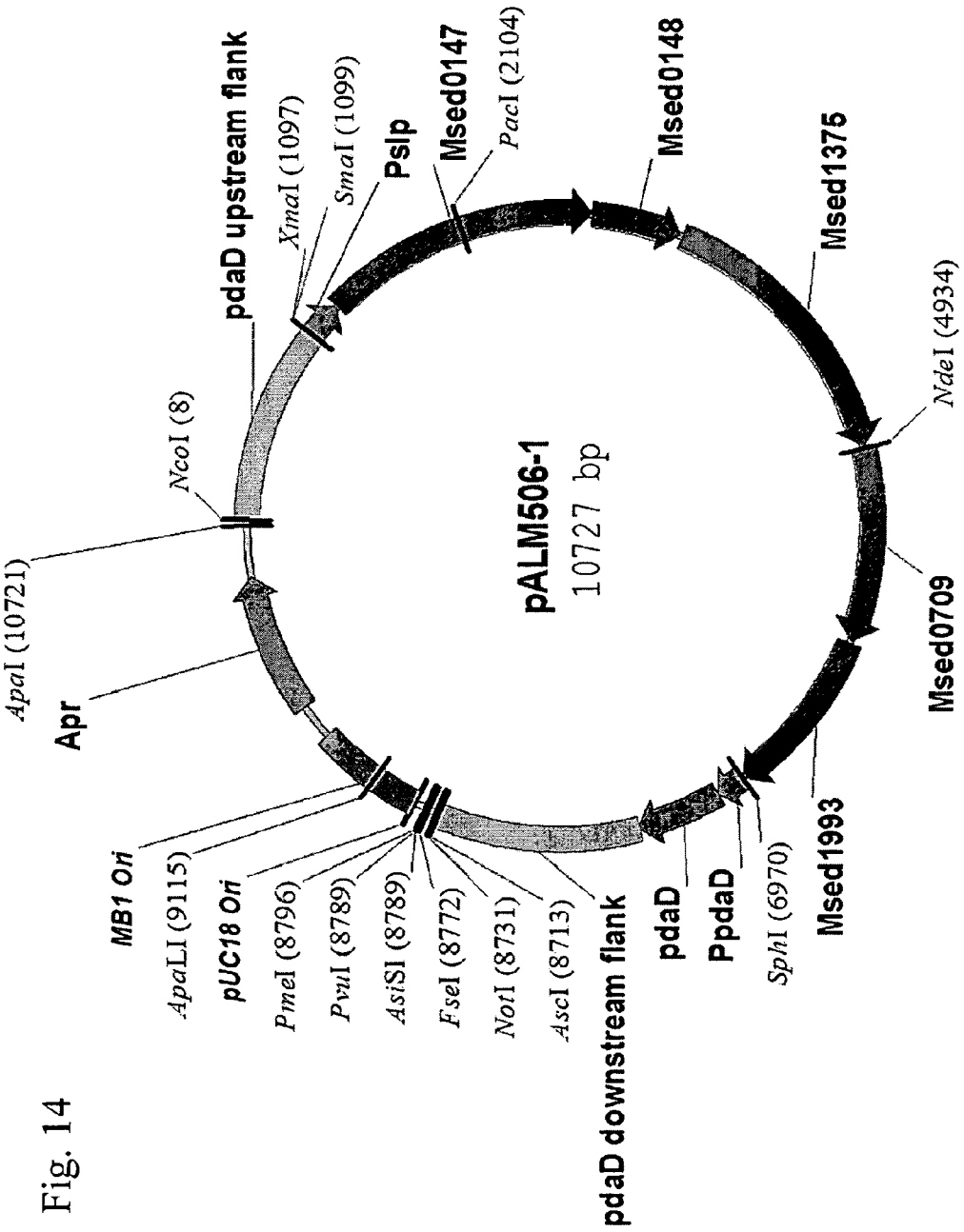
FIG. 14. Plasmid map of pALM506-1 used to transform P. furiosus strain ΔpdaD to generate strain PF506.
Figure 15:
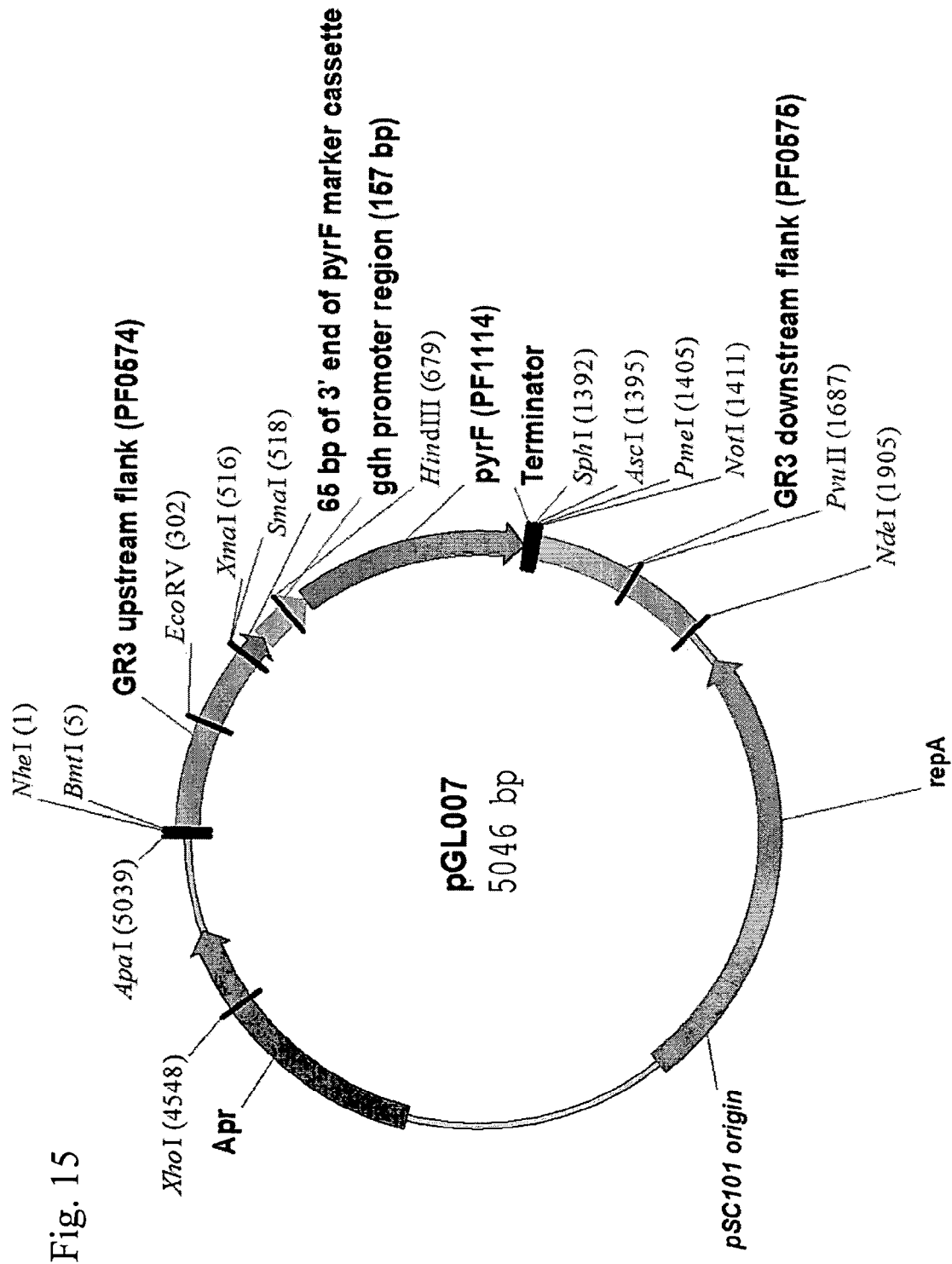
FIG. 15. Plasmid map of pGL007 vector targeting the region between PF0574 and PF0575 in the P. furiosus genome.
Figure 16:
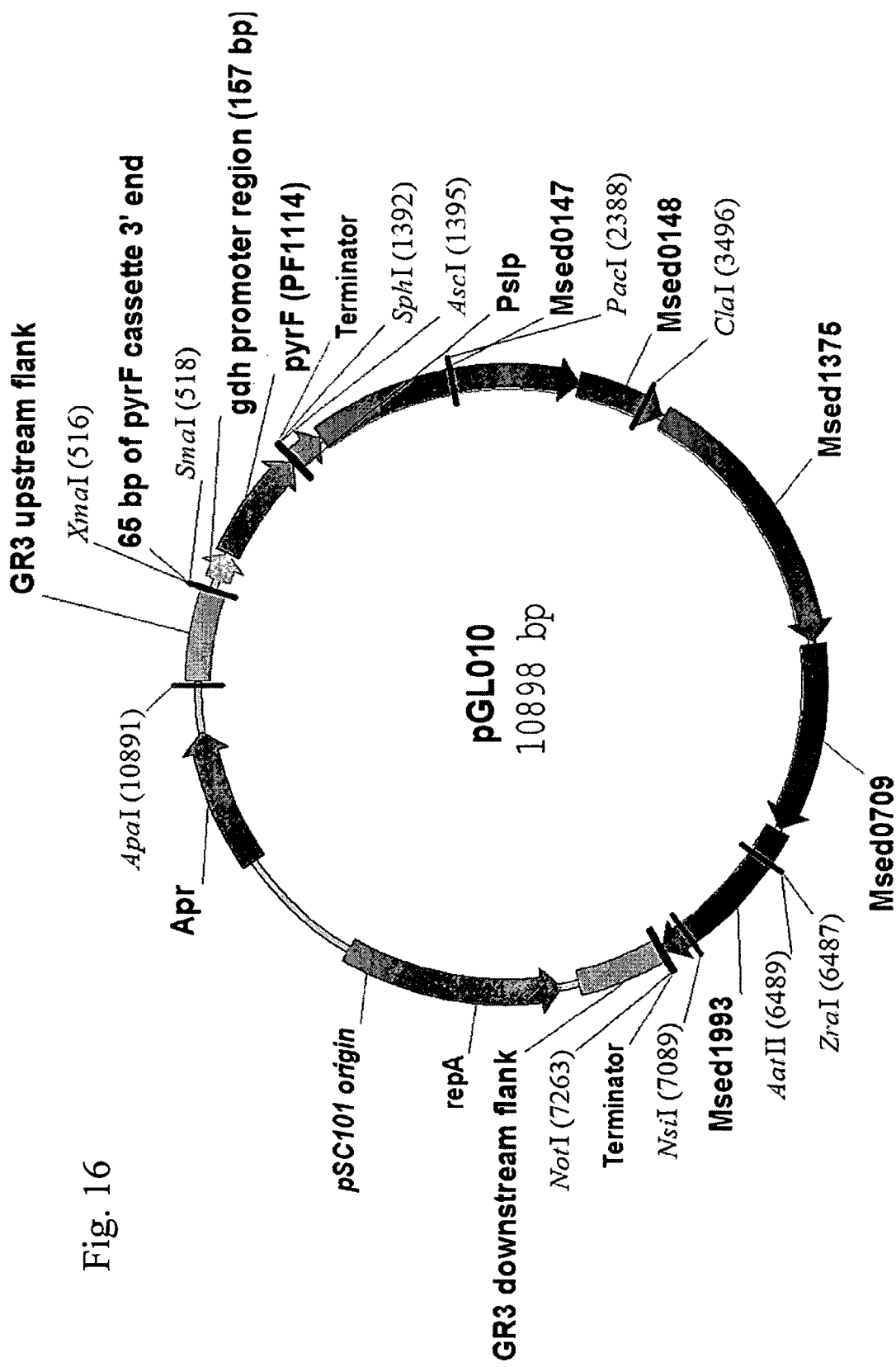
FIG. 16. Plasmid map of pGL010 used to transform P. furiosus COM1 to generate strain MW56.

Construction of vectors for insertion of the SP1 operon into *P. furiosus*. The SP1 expression cassette (FIG. 11B) was cloned into pSPF300 (Hopkins et al., 2011, *PLoS One* 6(10):e26569), generating the plasmid pALM506-1, to be used for targeted insertion of the synthetic SP1 operon into the *P. furiosus* ΔpdaD strain (FIG. 14). SOE-PCR (Horton et al., 1989, *Gene* 77(1):61-68) was used to combine ~0.5 kb flanking regions targeting homologous recombination in the integenic space between convergent genes PF0574-PF0575, with a marker cassette, including restriction sites for cloning. The marker cassette for uracil prototrophic selection consisted of the pyrF gene driven the gdh promoter region (Pgdh, 157 bases upstream of PF1602) and terminated with 12 bases of the 3' UTR of the hpyA1 gene (5'-aatcttttttag (SEQ ID NO:326), PF1722). A 65-b sequence of the 3' end of the marker cassette (5'-ctaaaaaagattttatcttgagctccattat-tcacctcctcgaaaatcttatagcggcttccc (SEQ ID NO:327)) was repeated at the beginning of the cassette to serve as a homologous recombination region for selection of marker removal (Farkas et al., 2012, *Appl Environ Microb* 78(13): 4669-4676). Vector pGL007 targeting homologous recombination at the PF0574-PF0575 intergenic space was constructed by cloning the SOE-PCR product into pJHW006 (Lipscomb et al., 2011, *Appl Environ Microb* 77(7):2232-2238) (FIG. 15). The SP1 expression cassette was PCR-amplified from pALM506. A terminator sequence was added to the 3' end of the operon (5'-aatcttttttag (SEQ ID NO:328), from the 3' UTR of PF1722), and the construct was cloned into the AscI-NotI sites of pGL007 to make pGL010 (FIG. 16), for targeted insertion of the SP1 operon at the PF0574-PF0575 intergenic space. Transformation of *P. furiosus* ΔpdaD strain was performed as previously described for COM1 (Lipscomb et al., 2011, *Appl Environ Microb* 77(7): 2232-2238) except that the defined medium contained maltose instead of cellobiose as the carbon source and was supplemented with 0.1% w/v casein hydrolysate. Transformation of COM1 was performed as previously described (Lipscomb et al., 2011, *Appl Environ Microb* 77(7):2232-2238) except that linear plasmid DNA was used for transformation.

Growth of *P. furiosus*. Strains were cultured as previously described in a sea-water based medium containing 5 g/L maltose and 5 g/L yeast extract, 0.5 μg/L riboflavin, and 20 μM uracil or 4 mM agmatine as needed (Lipscomb et al., 2011, *Appl Environ Microb* 77(7):2232-2238). Cultures were grown at 95° C. until ~1×10$^8$ cells/mL and then cooled at 23° C. until the temperature reached 70 to 75° C., which was maintained for up to 48 hours. For growth in a 20 L fermenter, the culture was sparged with 10% $CO_2$/90% $N_2$, stirred, and the pH was maintained at 6.8 by addition of 10% NaHCO$_3$. Cell extracts prepared anaerobically as described previously (Lipscomb et al., 2011, *Appl Environ Microb* 77(7):2232-2238) in 100 mM MOPS, pH 7.5, re-concentrated three-times with a 3 kDa centrifugation filter and stored at −80° C.

Growth of *M. sedula* for biochemical assays and product analysis. *M. sedula* (DSM 5348) was grown autotrophically at 70° C. with micro-bubblers feeding 1 mL/min 80/20 H$_2$/CO$_2$ and 100 mL/min air in the defined medium, DSMZ 88, at pH 2.0 as previously described (Han et al., 2012, *Appl Environ Microbiol* 78(17):6194-6202). To obtain cell-free extracts, frozen cell pellets were anaerobically suspended in 50 mM Tris HCl pH 8.0 containing 0.5 μg/mL DNase I and stirred for 1 hr in an anaerobic chamber. The cell extract was centrifuged at 100,000×g for 1 hr and the supernatant was stored at −80° C.

E1, E2 and E3 assays. All reactions were carried out in sealed anaerobic cuvettes at 75° C. containing 100 mM MOPS pH 7.5, 5 mM MgCl$_2$, 5 mM DTT. After addition of NADPH (to $A_{340}$~1.0) and the relevant substrate (see below), NADPH oxidation was measured at 340 nm. The substrates for the E2, E2+E3 and E1+E2+E3 assays were succinyl-CoA, malonyl-CoA and acetyl CoA (each 1 mM) respectively. The latter assay also contained 1 mM ATP, and 10 mM NaHCO$_3$. E1 activity was measured by phosphate release. The assay contained 10 mM NaHCO$_3$, 1 mM 4 ATP, and 1 mM acetyl-CoA. Samples (20 μL) were removed at 2-4 min, diluted with water (180 μl), and the BioVision (Mountain View, Calif.) phosphate assay reagent (20 μl) was added. The phosphate produced was calculated using a molar extinction coefficient of 90,000 M$^{-1}$ cm$^{-1}$ at 650 nm.

Measurement of 3-hydroxypropionic acid (3-HP). 3-HP (H0297, 30%, w/v, in water) was obtained from TCI America (http://www.tciamerica.net/). By HPLC and $^1$H NMR, it was 75% pure with the remaining 25% as 3,3'-oxydipropanoic acid. For GC-MS analysis, inositol was the internal standard. Samples were freeze-dried, incubated in 2 M trifluoroacetic acid at 80° C. for 1 hr, dried under nitrogen, and per-O-trimethylsilylated by treatment with Tri-Sil (Pierce) at 80° C. for 30 minutes. GC-MS analysis was performed on an AT 7890n GC interfaced to a 5975C MSD using a Grace EC-1 column (30 m×0.25 mm). The exact mass of 3-HP-TMS is 162. Derivatization of 3-HP with 2-nitrophenyl hydrazine was carried out as described previously (Miwa et al., 2000, *Journal of Chromatography. A* 881(1-2):365-385). The 3HP-hydrazide was extracted by adding 1.0 mL of 1 M KPO$_4$ buffer pH 7.0 and 1.5 mL of ether to 800 μL of the sample, centrifuging for 10 min at 6,000×g to separate the phases, removing the top ether layer and evaporating. The dried sample was resuspended in 200 μL ethanol and 10-50 μL aliquots were analyzed by HPLC. The column and run conditions were as follows: column, Supelco LiChrosorb RP-8 (5 μm); solvent system, A 0.05% TFA, B 100% acetonitrile; gradient 0-20 min, 0-100% B, 20-22 min: 100% B; flow rate: 1 mL/min; temperature: 30° C. For ESI-MS analysis, the dried derivative was dissolved in methanol and directly injected on a Perkin-Elmer API 1 plus in negative mode. The mass of the anionic 3-HP-hydrazide derivative is 224.

Production of 3-HP in vitro from malonyl-CoA by E2+E3 and from acetyl-CoA by E1+E2+E3. To the *P. furiosus* extract (1-2 mg/mL) in 100 mM MOPS pH 7.5, 5 mM MgCl$_2$, and 5 mM DTT, was added 1-2 mM malonyl-CoA (for E2+E3) or 10 mM NaHCO$_3$ (or 100% CO$_2$ in the gas phase), 2 mM ATP and 2 mM acetyl-CoA (for E1+E2+E3). The electron source was 2 mM NADPH or 0.5 mM NADP with 20% H$_2$ in the headspace. Sealed anaerobic vials containing the reaction mixture were incubated at 75° C. for up to 2 hr. Samples were derivatized with 2-nitrophenyl hydrazine and analyzed for 3-HP by HPLC as described above.

Product analysis of E1+E2+E3 activities in whole cells. *P. furiosus* strains PF506 and MW56 were grown in 2 L cultures at 95° C. for 10 hours until cell densities of 1×10$^8$ cells/mL and then cooled and incubated at 75° C. for 16 hours. Harvested cells were suspended to 5×10$^{10}$ cells/mL in 100 mM MOPS pH 7.5 and base salts (28 g/L NaCl, 3.5 g/L MgSO$_4$.7H$_2$O, 2.7 g/L MgCl$_2$.6H$_2$O, 0.33 g/L KCl, 0.25 g/L NH$_4$Cl, 0.14 g/L CaCl$_2$.2H$_2$O). The cell suspension was sealed in a serum vial, degassed with argon, and cysteine HCl (0.5 g/L), NaHCO$_3$ (10 mM) and either maltose (10 mM) or pyruvate (40 mM) were added. The vials were degassed and flushed with H$_2$ and incubated at 75° C. for 60 minutes. Samples for 3-HP analysis were derivatized with 2-nitrophenyl hydrazine, using 1 mM p-hydroxyphenyl acetic acid as an internal standard, ether-extracted and analyzed by HPLC as described above.

Analysis of the *P. furiosus* culture medium for 3-HP. *P. furiosus* strains PF506, MW56 and COM1 were grown in 50 mL cultures with maltose (10 mM) as the carbon source until a cell density of 8×10$^7$ cells/mL was reached. The incubation temperature was then shifted to 72° C. for up to 4 days. Sample (1 mL) were periodically removed, centrifuged (10,000×g, 10 min) and to a 100 μl aliquot of the supernatant (the spent medium) 1 mM p-hydroxyphenyl acetic acid was added as an internal standard. The sample was derivatized with 2-nitrophenyl hydrazine, ether-extracted and analyzed by HPLC as described above.

Results and Discussion

The genes that were incorporated into *P. furiosus* to enable it to utilize carbon dioxide are the first part of the 3-hydroxypropionate/4-hydroxybutyrate pathway of *M. sedula*, which consists of 13 enzymes in total (Ramos-Vera et al., 2011, *J Bacteriol* 193(5):1201-1211). In one turn of the cycle, two molecules of carbon dioxide are added to one molecule of acetyl-CoA (C$_2$) to generate a second molecule of acetyl-CoA (FIG. 11C). The cycle can be divided into three sub-pathways (SP1-SP3) where SP1 generates 3-hydroxypropionate (3-HP) from acetyl-CoA and carbon dioxide, SP2 generates 4-hydroxybutyrate (4-HB) from 3-HP and carbon dioxide, and SP3 converts 4-HB to two molecules of acetyl-CoA. The reducing equivalents and energy for the pathway are supplied by NADPH and ATP, respectively (FIG. 11D). Notably, the 3-HP/4-HB pathway is purportedly more energetically efficient than carbon dioxide fixation by the ubiquitous Calvin cycle (Berg et al., 2007, *Science* 318(5857):1782-1786).

The first three enzymes of the Msed 3-HP/4-HB cycle comprise the SP1 pathway and together they produce 3-HP from carbon dioxide and acetyl-CoA (FIG. 11B). The three enzymes are referred to here as: E1 (acetyl/propionyl-CoA carboxylase, encoded by Msed_0147, Msed_0148, Msed_1375), E2 (malonyl/succinyl-CoA reductase, Msed_0709) and E3 (malonate semialdehyde reductase, Msed_1993) (Berg et al., 2007, *Science* 318(5857):1782-1786; Hügler et al., 2003, *Eur J Biochem* 270(4):736-744; Alber et al., 2006, *J Bacteriol* 188(24):8551-8559). E1 carboxylates acetyl-CoA using bicarbonate and requires ATP. E2 breaks the CoA-thioester bond and with E3, reduces the carboxylate to an alcohol with NADPH as the electron donor. E1 and E2 are bi-functional and are also involved in the SP2 part of the cycle (FIG. 11C). To demonstrate the concept, we expressed the *M. sedula* SP1 pathway in *P.*

*furiosus* so that the organism could utilize carbon dioxide for the production of 3-HP, using hydrogen as the electron donor. Hydrogen is utilized in *P. furiosus* by a native cytoplasmic hydrogenase (SHI) that reduces NADP to NADPH (Ma & Adams, 2001, *Method Enzymol* Volume 331:208-216). SHI is extremely active, even at 70° C., and a *P. furiosus* strain engineered to over-express the enzyme was previously developed (Chandrayan et al., 2012, *J Biol Chem* 287(5):3257-3264).

The five genes encoding the three enzymes (E1αβγ, E2, E3) of *M. sedula* SP1 were combined into a single synthetic operon with transcription driven by $P_{slp}$, a native, constitutive promoter of the highly expressed S-layer protein (PF1399) of *P. furiosus* (Chandrayan et al., 2012, *J Biol Chem* 287(5):3257-3264). The *M. sedula* ribosomal binding sites (RBS) for E1(γ), E2 and E3 were replaced with RBSs for known highly-expressed *P. furiosus* proteins (FIG. 1A). The *M. sedula* RBS for E1β was retained since the two genes, E1α and E1β, appear to be translationally-coupled. The SP1 operon was inserted into *P. furiosus* (strain COM1) at two genome locations. In *P. furiosus* strain PF506, the SP1 operon was inserted at the site of the pdaD marker (PF1623; FIG. 14). The MW56 strain contained the SP1 operon between convergently-transcribed genes (PF0574 and PF0575: FIGS. S2 and S3) within a ~100-bp region having little to no transcriptional activity, according to a previous tiling array study of *P. furiosus* (Yoon et al., 2011, *Genome Res* 21(11):1892-1904). The *P. furiosus* strains used here are summarized in Table 5.

TABLE 5

Strains used and constructed in this study.

| Strain | Parent | Genotype/Description | Reference |
|---|---|---|---|
| COM 1 | DSM 3638 | ΔpyrF | 1 |
| ΔpdaD | COM 1 | ΔpyrF ΔpdaD::$P_{gdh}$pyrF | 2 |
| PF506 | ΔpdaD | ΔpyrF ΔpdaD::pdaD $P_{slp}^-$E1αβγ-E2-E3 | This work |
| MW56 | COM 1 | ΔpyrF $P_{gdh}$pyrF $P_{slp}^-$E1αβγ-E2-E3 | This work |

1, Lipscomb et al., 2011, *Appl Environ Microbiol* 77:2232-2238; 2, Hopkins et al., 2011, *PLoS One* 6:e26569.

Figure 12:
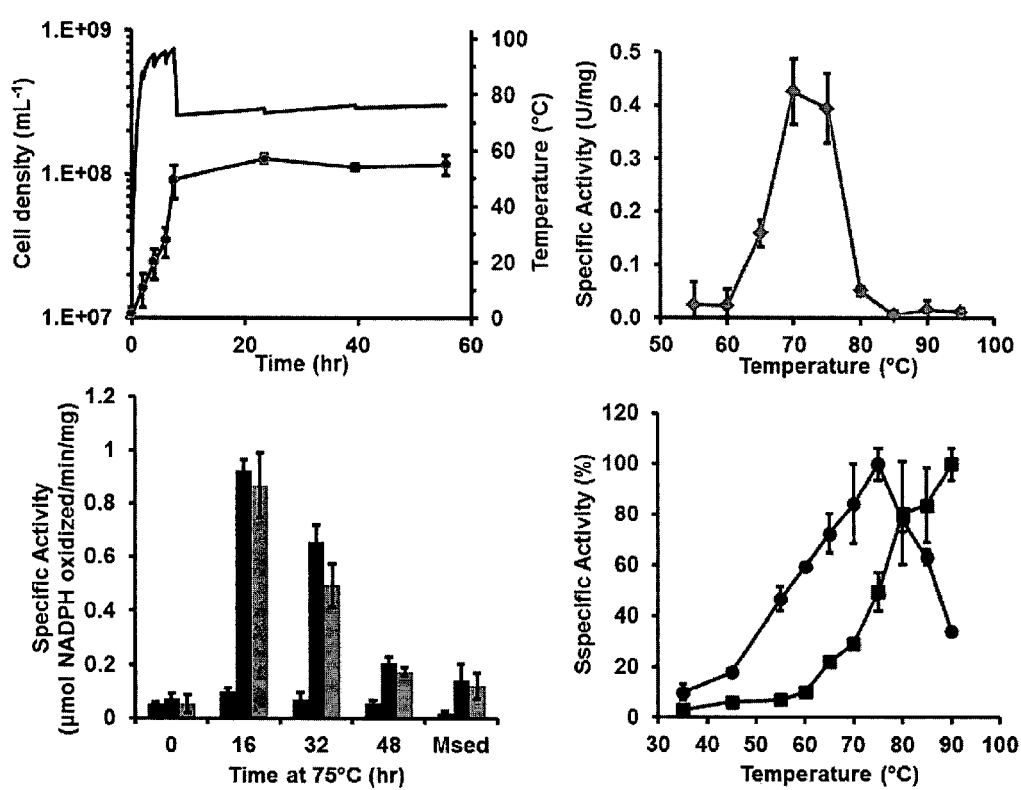
FIG. 12. Temperature-dependent production of the SP1 pathway enzymes in P. furiosus strain PF506. (A) Growth of triplicate cultures at 98° C. (circles) and temperature (black line) for the temperature shift from 98 to 75° C. are shown. (B) Specific activity (µmoles NADPH oxidized/min/mg) of the coupled activity of E2+E3 in cell-free extracts from cultures grown at 95° C. to a high cell density of $1\times10^8$ cells/ml and then incubated for 18 hrs at the indicated temperature. (C) Activities of E1, E2+E3, and E1+E2+E3 after the temperature shift to 75° C. for the indicated time period (see FIG. S4). The activities of a cell-free extract of autotrophically-grown M. sedula cells is also shown (labeled Msed). The specific activities are: E1+E2+E3 coupled assay with acetyl-CoA and bicarbonate, E2+E3 coupled assay with malonyl-CoA, and E2 with succinyl-CoA as substrates. (D) Temperature dependence of the coupled activity of E2+E3 (circles) in the cell-free extracts after induction at 72° C. for 16 hr. The activity of P. furiosus glutamate dehydrogenase in the same cell-free extracts is also shown (squares).
Figure 13:
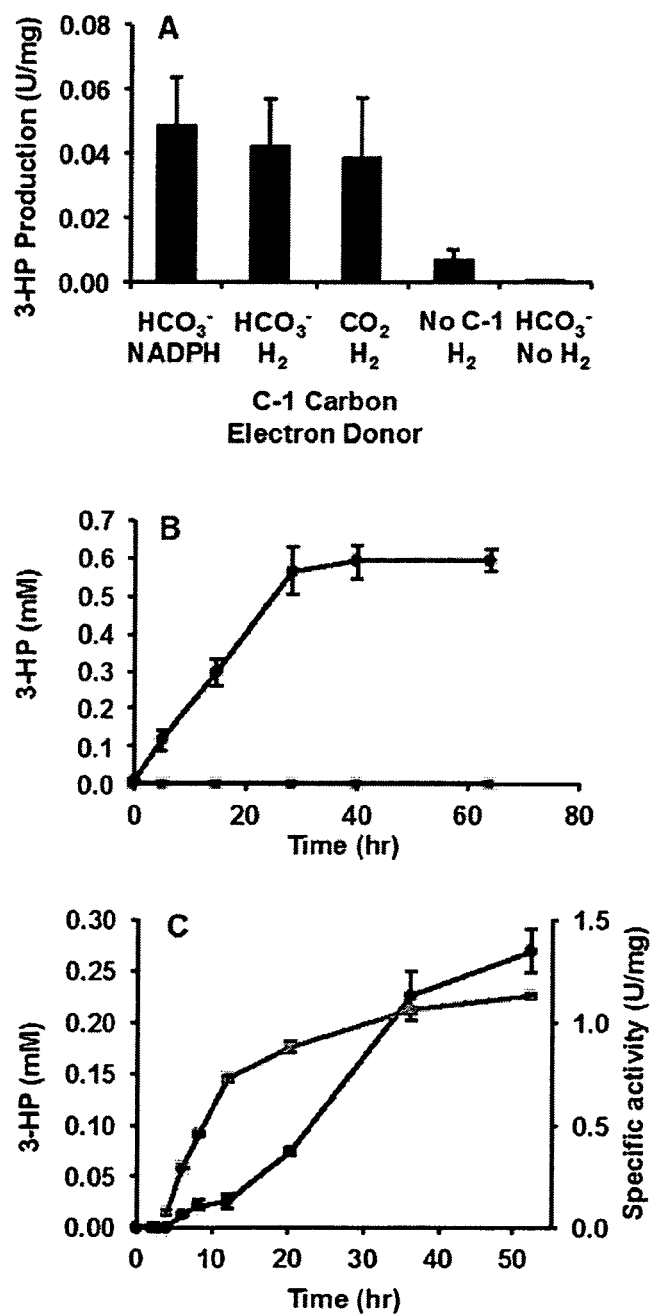
FIG. 13. 3-HP production by P. furiosus. Cells were grown at 95° C. and then incubated at 72° C. for 16 hr to produce the SP1 enzymes. (A) In vitro 3-HP production from acetyl-CoA performed in triplicate. The sources of the C1 carbon ($CO_2$ or $HCO_3^-$) and reducing equivalents (NADPH or NADP/$H_2$) are indicated. Rates are expressed as µmoles of 3-HP produced/min/mg. (B) In vivo 3-HP production by whole cells (static) using maltose as the source of acetyl-CoA in the presence of hydrogen gas and bicarbonate using cells grown in a 100 ml sealed bottles without pH control. The P. furiosus strains are MW56 (circles) and COM1 (squares). (C) In vivo 3-HP production by whole cells (stirred) of MW56 using maltose as the source of acetyl-CoA (circles) and E2+E3 specific activity of the cell-free extracts (diamonds) using cells grown in a 20 L fermenter with pH control (6.8).
Figure 18:
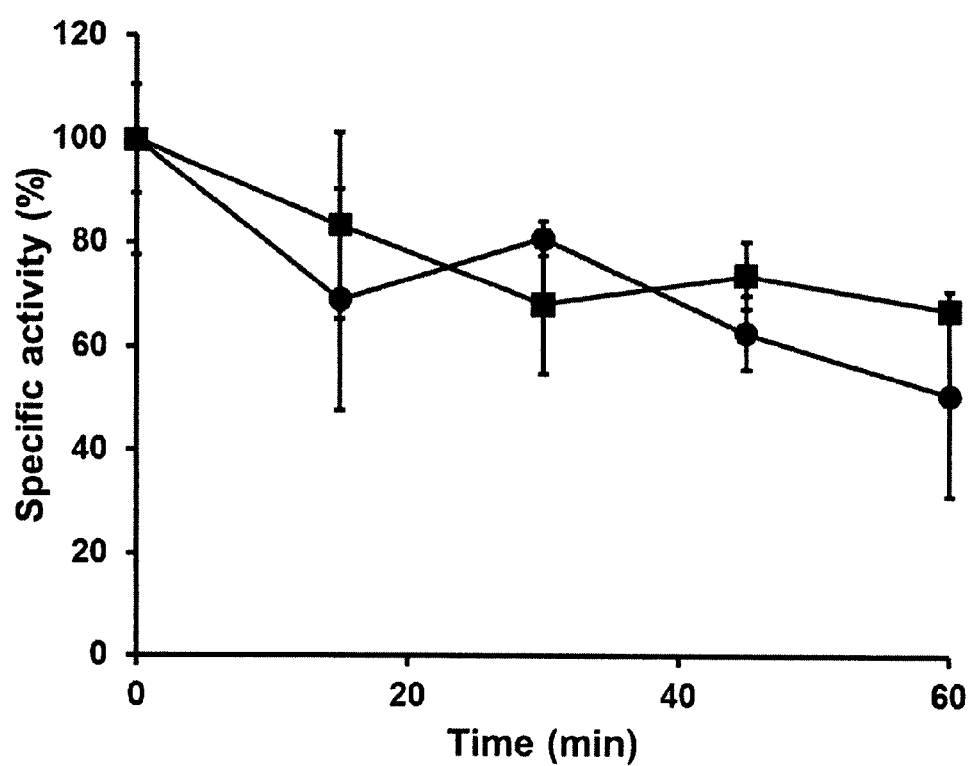
FIG. 18. Stability of E2 and E3 using an E2+E3 coupled assay at 75° C. after incubation at 90° C. for the indicated amount of time in cell-free extracts of P. furiosus strain PF506 (circles) and of the endogenous P. furiosus glutamate dehydrogenase (squares). The specific activity of E2+E3 in PF506 (grown at 72° C.) is about 2-fold higher than that measured in M. sedula. Activity is expressed as percent of maximum activity.

The premise for the temperature-dependent strategy is that *P. furiosus* ($T_{opt}$ 100° C.) shows little growth and has very low metabolic activity (Weinberg et al., 2005, *J Bacteriol* 187:336-348) near the temperature at which the enzymes from *M. sedula* ($T_{opt}$ 73° C.) are expected to be optimally active. In the recombinant *P. furiosus* strains (PF506 and MW56), the SP1 operon was under the control of a temperature-independent, constitutive promoter ($P_{slp}$), hence the operon will be transcribed at both 100° C. and 75° C. However, the resulting E1-E3 enzymes should be stable and active only near 75° C. *P. furiosus* strains PF506 and MW56 were, therefore, grown at 98° C. (to ~1×10$^8$ cells/ml) in closed static cultures and then transferred to 75° C. (FIG. 12A). There was no measurable activity of E1, E2 or E3 in cell-free extracts prior to the temperature change, but all three activities were present in cells after 16 hr at 75° C. Moreover, the specific activities were comparable to those measured in extracts of *M. sedula* cells grown autotrophically on hydrogen and carbon dioxide and to values reported by others (FIGS. 12C and 20) (Berg et al., 2010, *Nat Rev Microbiol* 8(6):447-460; Ramos-Vera et al., 2011, *J Bacteriol* 193(5):1201-1211). Indeed, when grown in a stirred, pH-controlled culture, the activity of the linked E2+E3 enzymes in strain MW56 continued to increase over a 50 hr period, reaching over 8-fold greater than that measured in *M. sedula* (FIG. 13C). When strain PF506 was grown at 95° C. and then incubated for 16 hours at temperatures between 55° and 95° C., the maximum specific activity of the linked E2+E3 enzymes was measured in cultures incubated at 70 and 75° C., with dramatically lower values at 65 and 80° C. (FIG. 12B). This clearly indicates that the *M. sedula* enzymes functioned optimally in *P. furiosus* at 70-75° C., especially since significant E2+E3 activity could be measured at assay temperatures above 75° C. using cell-free extracts prepared from cultures incubated at 70-75° C. (FIG. 12D). Moreover, the enzymes are very thermostable, with a half-life of approximately 60 min at 90° C. (FIG. 18). This suggests that the lack of enzyme activity of the *M. sedula* enzymes (and of 3-HP production) in cultures that were incubated at 80° C. or higher is not due to the thermal instability of the *M. sedula* enzymes per se, but rather to the temperature sensitivity of the protein folding process during the synthesis of these enzymes, which is optimal in the 70-75° C. range.

Figure 19:
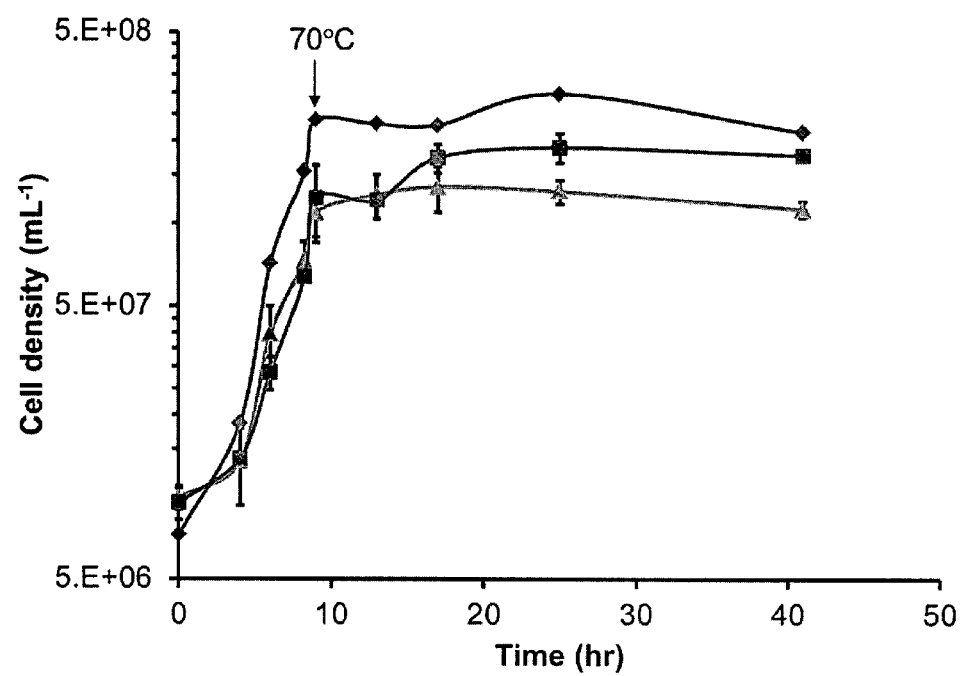
FIG. 19. Growth of P. furiosus COM1, MW56 and PF506 during the temperature shift from 98° C. to 70° C. Cell densities of COM1 (diamonds), MW0056 (squares), and PF506 (triangles) are indicated. The 400 mL cultures were grown at 95° C. for 9 hr and then allowed to cool at room temperature to 70° C. before being placed in a 70° C. incubator.
Figure 20:
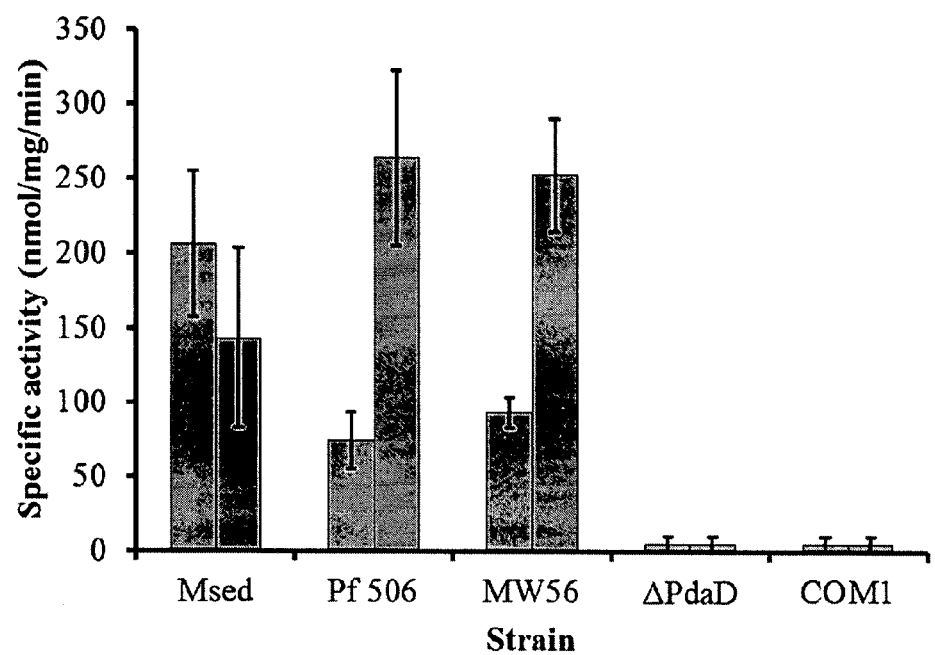
FIG. 20. Enzyme activities of E1 (left bar of each pair) and coupled E2+E3 (right bar of each pair) in cell-free extracts of the indicated P. furiosus strains after incubation at 70° C. for 16 hr, compared to that measured for the cell-extract of autotrophically-grown M. sedula cells (labeled Msed).
Figure 21:
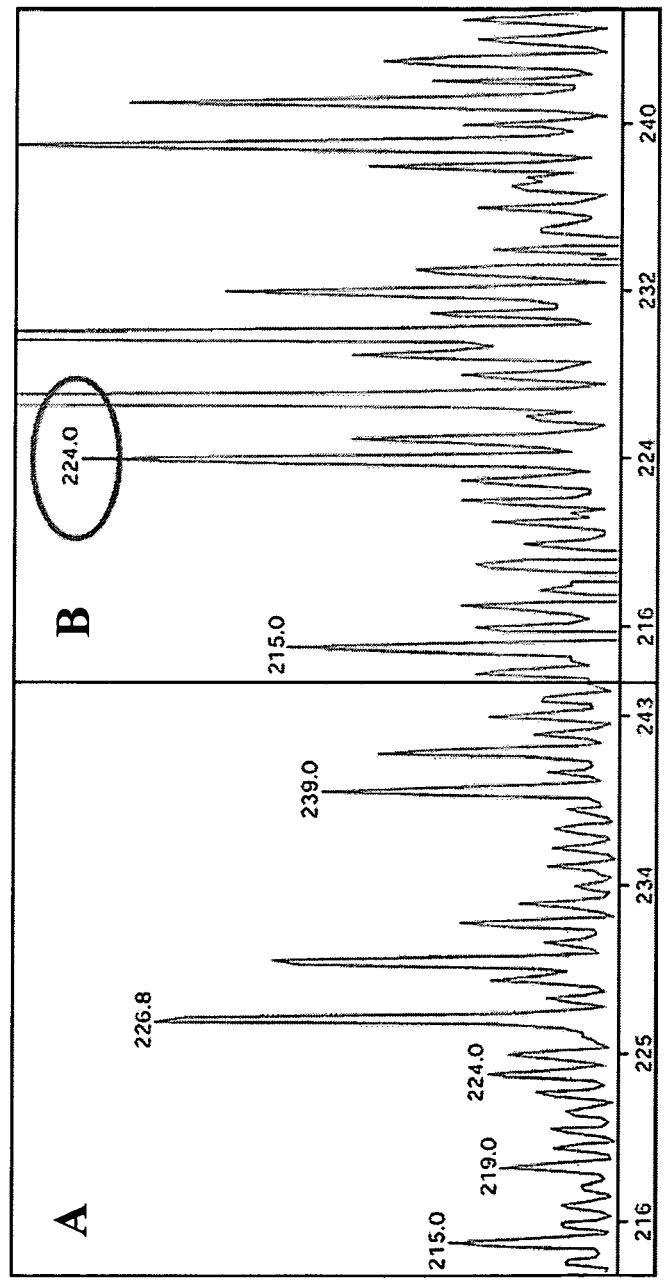
FIG. 21. ESI-MS identification of 3-HP produced from acetyl-CoA, $CO_2$ and $H_2$ (or NADPH) by cell-free extracts of P. furiosus strains ΔPdaD (A) and PF506 (B). The MS peak corresponding to the 3HP derivative (m/z 224, circled) was present above background only in the recombinant PF506 strain.

To determine the nature of the products of the SP1 pathway, recombinant *P. furious* strains PF506 and MW56 were grown at 95° C. (to ~1×10$^8$ cells/ml) and then transferred to 70° C. for 16 hours (FIG. 19). In extracts of these cells, the specific activities of the E1, E2, and E3 enzymes were comparable to those measured in extracts of autotrophically-grown *M. sedula* cells (FIG. 20). Two methods were used to detect 3-HP and to confirm its production by the SP1 pathway in the recombinant *P. furiosus* strains. In the presence of acetyl-CoA, NaHCO$_3$, and either NADPH or hydrogen gas as the electron donor, the 2-nitrophenylhydrazide-derivative (3-HP/HZ; m/z 224) was identified by electrospray ionization mass spectrometry (ESI-MS) in cell-free extracts of PF506, but was not detected in extracts of the parent *P. furiosus* strain (FIG. 21). This was confirmed by gas chromatography-mass spectrometry (GC-MS) of the O-trimethylsilylate derivative of 3-HP (3HP/TMS), using malonyl-CoA and either NADPH or hydrogen gas as the electron donor (Table 6). The GC-MS also allowed quantitation of 3-HP/TMS and showed that approximately 150 µM 3-HP was produced from malonyl-CoA, after a 2 hr incubation at 72° C. with extracts of PF506 containing NADP under hydrogen gas (Table 6).

TABLE 6

| Vial | Added Electron Donor | Substrate | Theoretical 3-HP | 3-HP/Inositol peak area | Estimated 3-HP |
|---|---|---|---|---|---|
| 1 | 2 mM NADPH | 2 mM malonyl-CoA | 1 mM | 0.0288 | 0.2 mM |
| 2 | 2 mM NADPH, H$_2$ | 2 mM malonyl-CoA | 2 mM | 0.0467 | 0.3 mM |
| 3 | 1 mM NADP, H$_2$ | 2 mM malonyl-CoA | 2 mM | 0.0274 | 0.2 mM |
| 4 | 1 mM NADP, H$_2$ | None (control) | 0 | 0.0064 | 0.05 mM |
| 5 | 1 mM NADP, H$_2$ | None (control) | 2 mM | 0.2839 | 2.0 mM |

For routine analysis of 3-HP, a method was developed to extract 3-HP/HZ and to separate and quantitate it by HPLC. As shown in FIG. 3A, this method was used to confirm 3-HP production from acetyl-CoA and carbon dioxide by the combined action of the enzymes E1, E2, and E3 in cell-free extracts. As expected, *P. furiosus* did not appear to further metabolize 3-HP, as the compound was stable when added to *P. furiosus* cultures. Moreover, the production of 3-HP from acetyl-CoA was dependent upon either NaHCO$_3$ or CO$_2$ as the C-1 carbon source and either NADPH or hydrogen gas (and NADP) as the electron donor (FIG. 13A). The incorporation of electrons from hydrogen gas and the carbon from carbon dioxide into a single desired product is essentially the paradigm for 'electrofuels' (Hawkins et al., 2011, *ACS Catalysis* 1:1043-1050).

Figure 22:
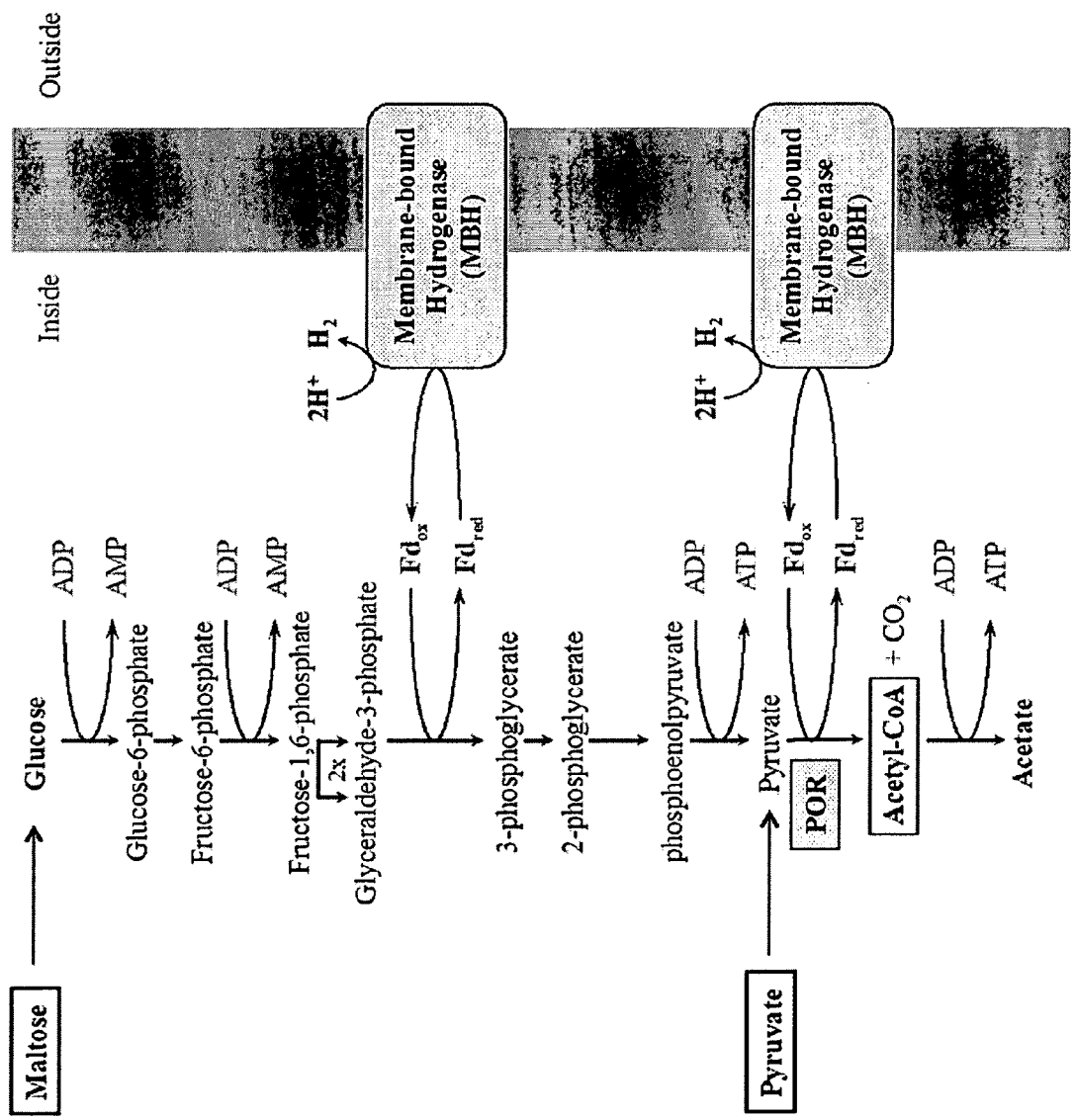
FIG. 22. Maltose and pyruvate metabolism by *P. furiosus*, and the key roles of pyruvate ferredoxin oxidoreductase (POR) in acetyl-CoA production and of the membrane-bound hydrogenase (MBH) in $H_2$ production.
Figure 23:
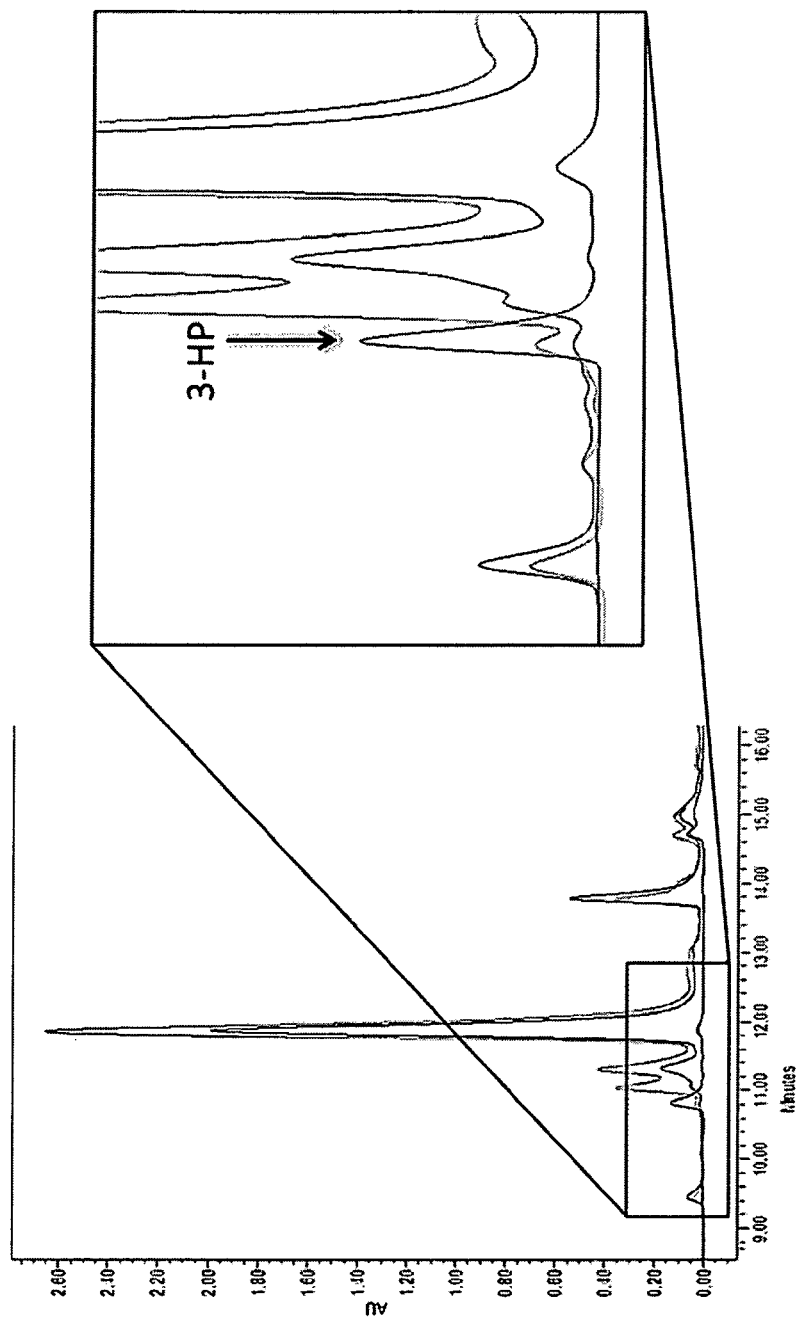
FIG. 23. In vivo production of 3-HP from maltose by whole cells of *P. furiosus* strain MW56 (A) and PF506 (B) after 10 min (blue) and 60 min (red) compared to a 1 mM 3-HP standard (black). A black arrow indicates the position of the 3-HP peaks. A total of 135 µM and 199 µM of 3-HP was produced by cell suspensions of MW56 ($5 \times 10^{10}$ cells/mL) and of PF506 ($5 \times 10^{10}$ cells/mL), respectively, after 60 min at 75° C.

*P. furiosus* grows by fermenting sugars (such as the disaccharide maltose) to acetate, carbon dioxide and hydrogen, and can also utilize pyruvate as a carbon source (Fiala & Stetter, 1986, *Arch. Microbiol.* 145: 56-61). Acetyl-CoA and carbon dioxide are generated as the product of the pyruvate ferredoxin oxidoreductase (POR) reaction (FIG. 22). The reduced ferredoxin is oxidized by a membrane-bound hydrogenase to generate hydrogen gas (Sapra et al., 2003, *Proc Natl Acad Sci USA* 100(13):7545-7550). Although growth is limited at 75° C. (Weinberg et al., 2005, *J Bacteriol* 187:336-348), it was expected that when whole cells were incubated at 75° C. with maltose or pyruvate, sufficient acetyl-CoA would be produced by the low metabolic activity of *P. furiosus* for the SP1 enzymes to produce 3-HP. This was confirmed by HPLC detection and quantitation of 3-HP as the 2-nitrophenylhydrazine derivative. For example, high cell density suspensions ($\geq 10^{10}$ cells/ml) of *P. furiosus* strains PF506 and MW56 produced up to 0.2 mM 3-HP after one hour incubation at 75° C. in the presence of maltose, hydrogen gas, and NaHCO$_3$ (FIG. 23), and 3-HP production was dependent upon the presence of maltose or pyruvate (Table 7). Moreover, recombinant *P. furiosus* strains PF506 and MW56, grown in static cultures to late-log phase ($\sim 1 \times 10^8$ cells/ml) at 98° C. on maltose, produced up to 0.6 mM 3-HP (60 mg/l) when subsequently incubated at 72° C. for up to 40 hours (FIG. 13B). Furthermore, in a stirred, pH-controlled culture, strain MW56 produced 3-HP continuously over a 50 hr period at 72° C. (FIG. 13C). Overall, there appeared to be no significant difference between the two recombinant *P. furiosus* strains in terms of 3-HP production. This indicated that the genome location of the synthetic operon derived from *M. sedula* was not a determining factor. This bodes well for the insertion of additional synthetic operons in *P. furiosus* to extend the results reported here to other industrial chemicals.

TABLE 7

3-HP production using maltose or pyruvate as the source of acetyl-CoA by whole cells of *P. furiosus* strains PF506 and MW56. The amount of 3-HP indicated was present in 1 mL of the cell suspension of *P. furiosus*.

| MW56 | | PF506 | |
|---|---|---|---|
| Pyruvate | Maltose | Pyruvate | Maltose |
| 155 nmol | 100 nmol | 70 nmol | 145 nmol |

In summary, this work demonstrates the use of hydrogen as the electron donor for carbon dioxide fixation into a product of great utility in the chemical industry, namely 3-HP. Moreover, it is carried out by an engineered heterotrophic hyperthermophile some 30° C. below the optimal growth temperature of the organism, conditions that support minimal growth, but sufficient metabolic activity is retained to sustain the production of 3-HP (Hawkins et al., 2011, *ACS Catalysis* 1:1043-1050). The reaction can be accomplished by cell-free extracts, and also by whole cells in culture using sugar (maltose) as the source of the acetyl-CoA and ATP in a hydrogen- and carbon dioxide-dependent manner. The feasibility of using hydrogen gas as the source of reducing power (NADPH) for chemical synthesis, in this case 3-HP, is also of high significance given the availability of relatively inexpensive natural gas as a hydrogen source (Kreysa, 2009, *ChemSusChem* 2(1):49-55). It is important to note that the low metabolic activity of *P. furiosus* at 72° C. was sufficient to provide the ATP needed for carbon dioxide fixation. These results are a significant step forward towards the overall goal of incorporating into *P. furiosus* the complete *M. sedula* 3-HP/4-HB pathway, in which two molecules of carbon dioxide are reduced to acetyl-CoA that can then be converted into a variety of valuable products including biofuels (Hawkins et al., 2011, *ACS Catalysis* 1:1043-1050). Clearly, there will be a balance between using a fixed carbon source (sugar) via the low metabolic activity of the host to produce ATP and the high catalytic activity of the heterologous enzymes to generate the desired product. The hydrogen-dependent fixation of carbon dioxide has enormous potential for the production of a variety of chemicals and fuels through strategic use of established biosynthetic pathways and exploiting the hyperthermophilicity of metabolically-engineered microbial hosts (Steen et al., 2010, *Nature* 463(7280):559-562); Peralta-Yahya & Keasling, 2010, *Biotechnol J* 5(2):147-162; Connor & Liao, 2009, *Curr Opin Biotechnol* 20(3):307-315; Kreysa, 2009, *ChemSusChem* 2(1):49-55).

EXAMPLE 3

Construction of *P. furiosus* Strains PF506 and MW56 Containing the SP1 Pathway for 3-Hydroxypropionate Production and the Control Strain MW43 for Optimizing Production of *M. sedula* Enzymes in *P. furiosus*

Figure 24:
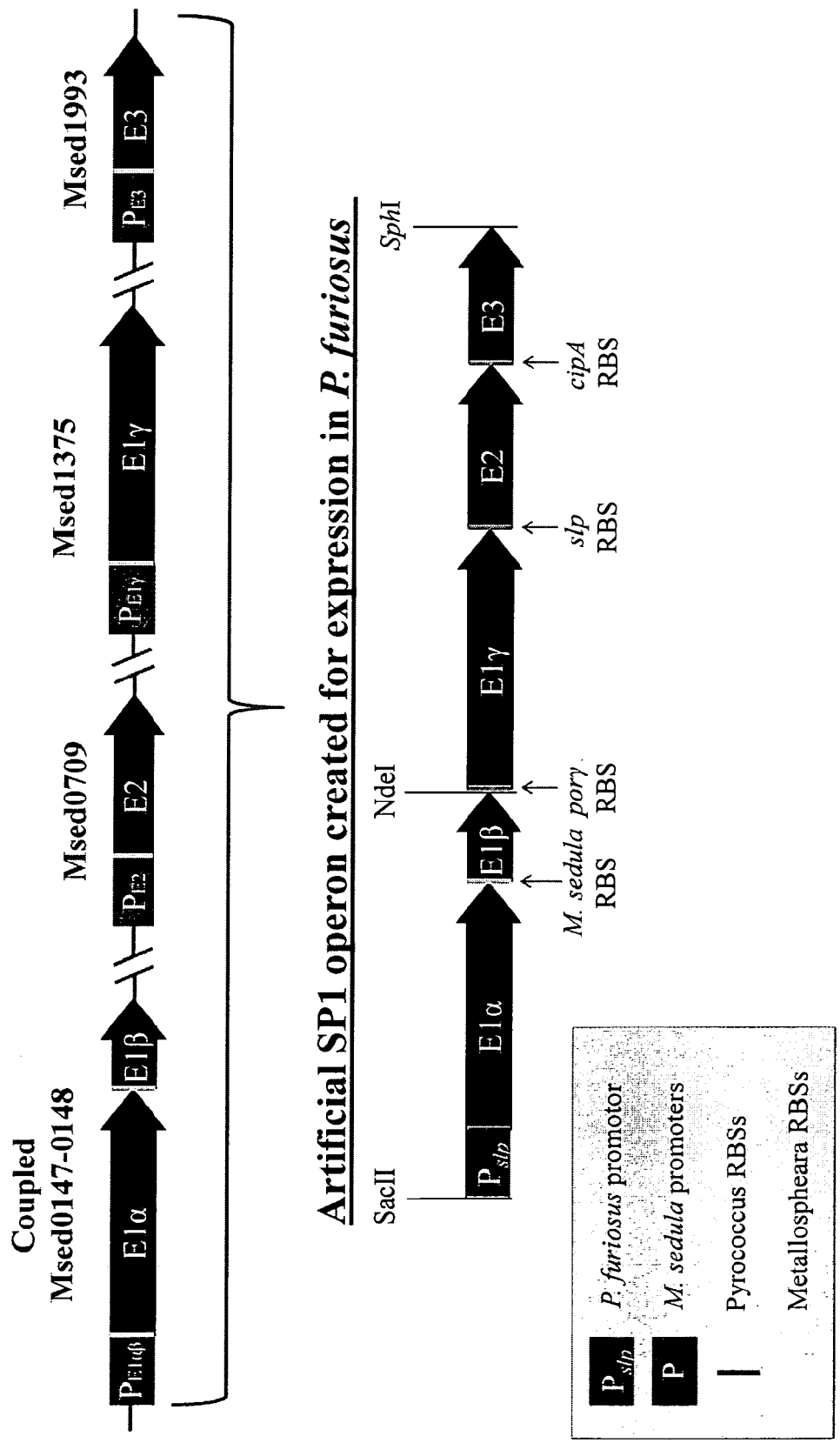
FIG. 24. Design of an artificial operon encoding SP1 (E1-E3) for expression in *P. furiosus*.

The five genes encoding the three enzymes (E1αβγ, E2, E3) of the *M. sedula* 3-HP/4-HB CO$_2$ fixation sub pathway I (SP1) are scattered across the *M. sedula* genome (FIG. 24). These genes have been combined into a single artificial operon using overlapping SOE-PCR (splicing by overlap extension and PCR, Horton, et al. 1989. Gene 77, 61), followed by integration of the expression cassette into the *P. furiosus* genome. Transcription of the artificial SP1 operon in *P. furiosus* is driven by P$_{slp}$, the native, constitutive promoter of the highly expressed S-layer protein (Chandrayan, S. K. et al. 2012. *J Biol. Chem.* 287, 3257-3264). To optimize translation of the SP1 genes in *P. furiosus*, the native *M. sedula* ribosomal binding sites (RBSs) for E1γ, E2 and E3 were replaced with optimal *P. furiosus* RBSs/linker regions for predicted and known highly expressed proteins, while retaining the *M. sedula* RBS for E1β since the two genes, E1α and E1β, appear to be translationally coupled.

Strategy for operon expression (SP1 and SP2B) in *P. furiosus*. The SP1 operon was inserted into the COM1 strain of *P. furiosus* at two locations on the genome giving rise to two recombinant *P. furiosus* strains, PF506 and MW56. In addition, a control strain, MW43, was constructed to explore the temperature dependent expression of *M. sedula* genes in *P. furiosus*. MW43 contained subpathway 2B (SP2B; E7, E8 and E9) of the 3HP/4HB cycle.

PF506: the SP1 operon was inserted at the site of the pdaD marker.

MW56: the SP1 operon was inserted into one (GR3) of eleven genome regions previously identified as having little or no transcriptional activity.

MW43: the SP2B operon was inserted into GR2.

Figure 25:
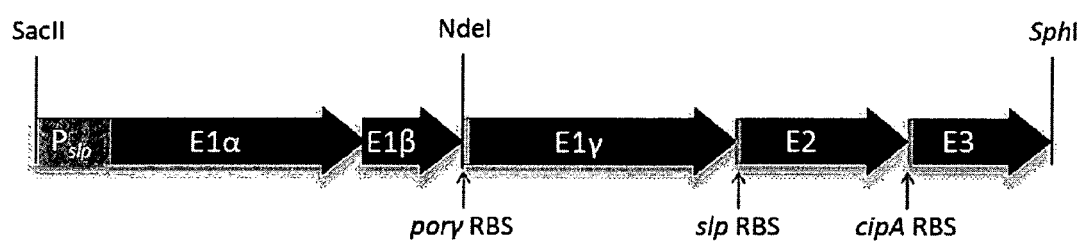
FIG. 25. SP1 expression cassette for cloning into pSPF300 vector. The sequence of the SP1 expression cassette cloned into pSPF300 to make pALM506-1 is disclosed in Kelly et al. (WO 2013/067326).
Figure 26:
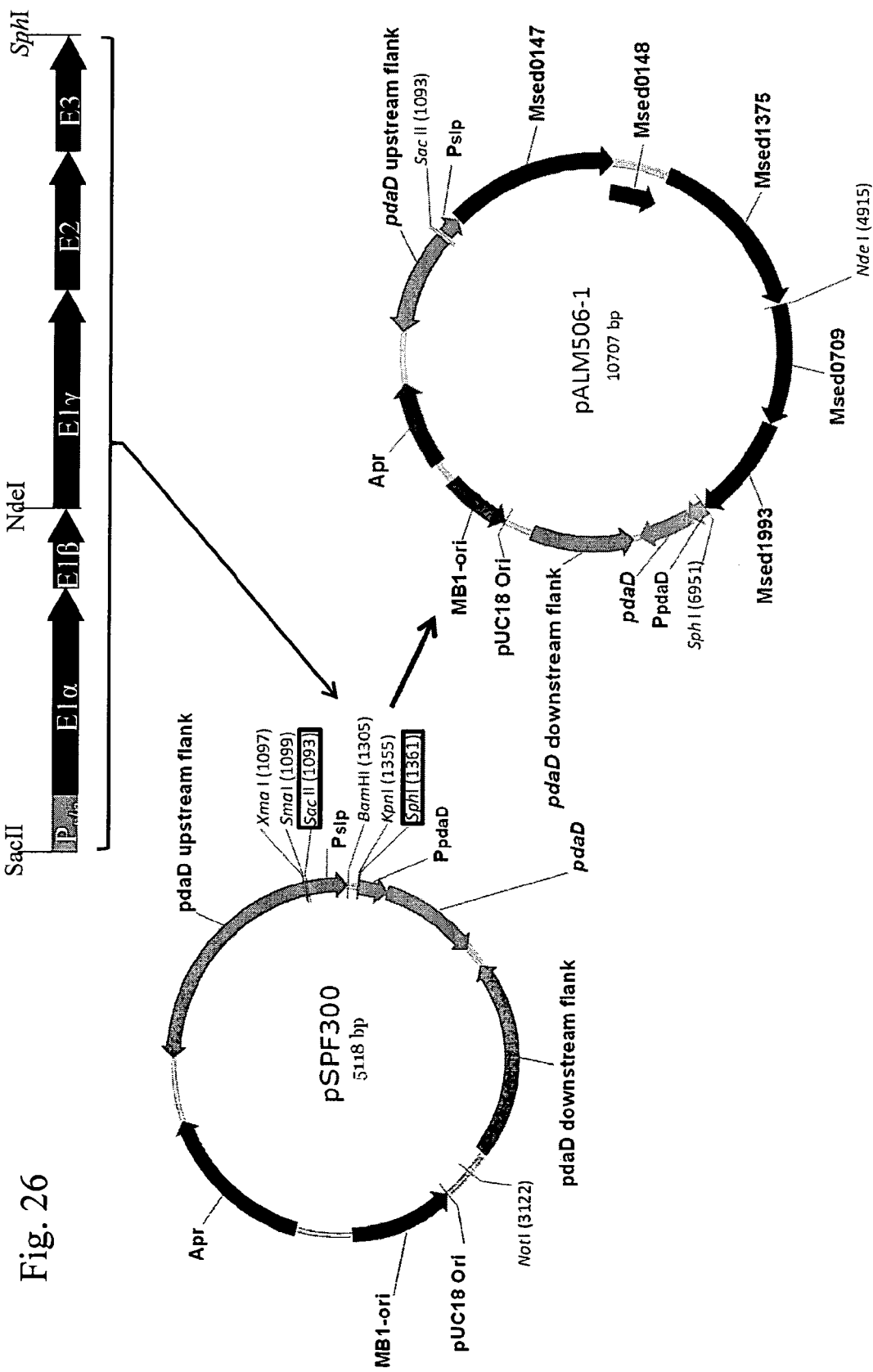
FIG. 26. Construction of pALM506-1 plasmid for transformation of *P. furiosus* strain ΔpdaD (Kelly et al., WO 2013/067326)).

Construction of synthetic operon for expression of SP1 genes. PCR was performed using *P. furiosus* genomic DNA or *M. sedula* genomic DNA to generate the individual PCR products of the *P. furiosus* S-layer promotor and the five *M. sedula* SP1 genes, consisting of coupled E1αβ (Msed_0147-Msed_0148), E1γ (Msed_1375), E2 (Msed_0709) and E3 (Msed_1993). PCR primers were designed to contain optimized *P. furiosus* ribosomal binding sites and spacing (Table 4) and to allow splicing of the individual PCR products generated (Table 4 and Table 8). SOE-PCR (Horton, et al. 1989. Gene 77, 61) was performed to combine the individual PCR products and generate the expression cassette for SP-1 (FIG. 25). The expression cassette was digested with SacII and SphI restriction enzymes and cloned into the SacII-SphI sites of the transformation vector, pSPF300 (Hopkins et al., 2011, *PLoS One* 6(10):e26569), generating the transformation plasmid, pALM506-1, for targeted insertion into the ΔpdaD strain of *P. furiosus* (FIG. 26).

TABLE 8

Upstream and intergenic regions with optimized native Pf RBS sequences and spacing.

| | | |
|---|---|---|
| E1-α: Msed_0147 | GGGAGGTGGAGAAAATG (SEQ ID NO: 329) | PF1399 (slp, S-layer protein) RBS |
| E1-β: Msed_0148 | GGGTGATGTGGGGATGA (SEQ ID NO: 330) | Msed0148 (native Msed RBS: coupled E1-αβ) |
| E1-γ: Msed_1375 | TAAGGAGGTTTGAAGATG (SEQ ID NO: 331) | PF0791 (porγ: Pyruvate ferredoxin oxidoreductase γ) RBS |
| E2: Msed_0709 | TAAGGGAGGTGGAGCATATG (SEQ ID NO: 332) | PF1399 (slp, S-layer protein) RBS |
| E3: Msed_1993 | TGAGGTGATATGCAATG (SEQ ID NO: 333) | PF0190 (cipA, cold induced protein A) RBS |

Transformation of *P. furiosus* ΔpdaD strain to yield *P. furiosus* strain PF506 containing the SP1 operon. Transformation of *P. furiosus* ΔpdaD strain was performed as previously described for COM1 (Lipscomb, et al. 2011. Appl Environ Microbiol. 77(7):2232-8) with a few changes, in that sequence-verified plasmid DNA was used for transformation and the defined medium contained maltose instead of cellobiose as the carbon source and was supplemented with 0.1% w/v casein hydrolysate. Briefly, pALM506-1 was mixed (at ~5 µg plasmid DNA/mL culture) with an aliquot of a fresh overnight culture of ΔpdaD grown in defined maltose (DM) medium containing 0.1% w/v casein hydrolysate and 4 mM agmatine. The transformation mixtures were spread on DM plate medium containing 0.1% w/v casein hydrolysate and 20 µM uracil and incubated at 90° C. for ~95 h. Transformant colonies were further purified by six serial transfers in DM liquid medium containing 0.1% w/v casein hydrolysate and 20 µM uracil. The presence of the insert in the transformed strains was verified by PCR screening of isolated genomic DNA.

Figure 27:
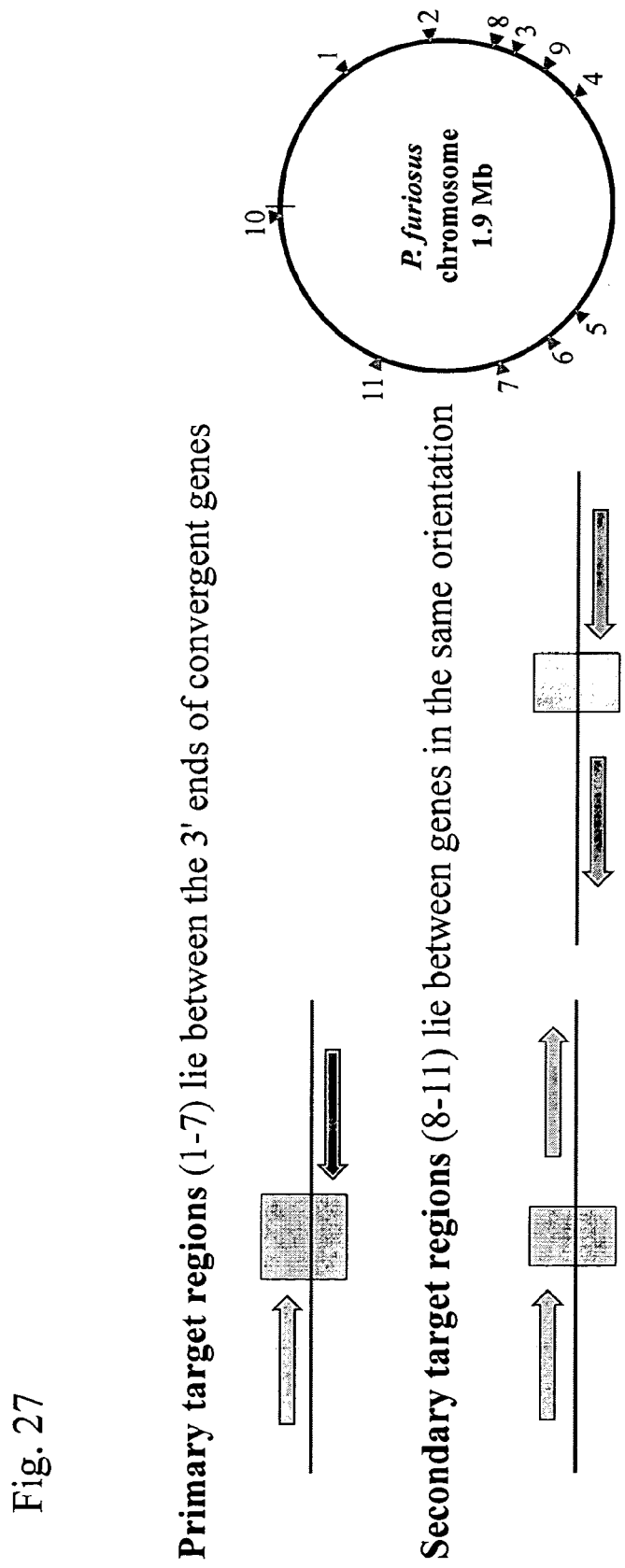
FIG. 27. Transcriptionally inactive zones for foreign gene insertion.

Determining transcriptionally inactive regions for foreign gene insertion. *P. furiosus* intergenic genome regions with little to no transcriptional activity were found using tiling array data of gene expression in wild-type *P. furiosus* from early log to early stationary phase, relative to a mid-log time point ((Yoon, et al. 2011. Genome Res. 21(11):1892-904), FIG. 27). Primary targets consisted of intergenic space between convergent genes, so as to avoid gene promoter regions. Secondary targets consisted of intergenic space between genes in the same orientation, separated by at least ~450 bases. Ten total genome regions with little to no transcriptional activity were identified for use as foreign gene insertion sites. Tiling array data was mapped to the NCBI reference genome sequence (*P. furiosus* DSM3638); however, the genetically tractable strain of *P. furiosus*, COM1, has some genome rearrangements which affect the positions of the genome regions within the chromosome (Lipscomb G L, et al. 2011. Appl Environ Microbiol. 77(7):2232-8, Bridger S L, et al. 2012. J Bacteriol. 194(15): 4097-106) (FIG. 28). Namely, genome region 10 was located within a region of the *P. furiosus* genome which was inverted in the COM1 strain.

Figure 30:
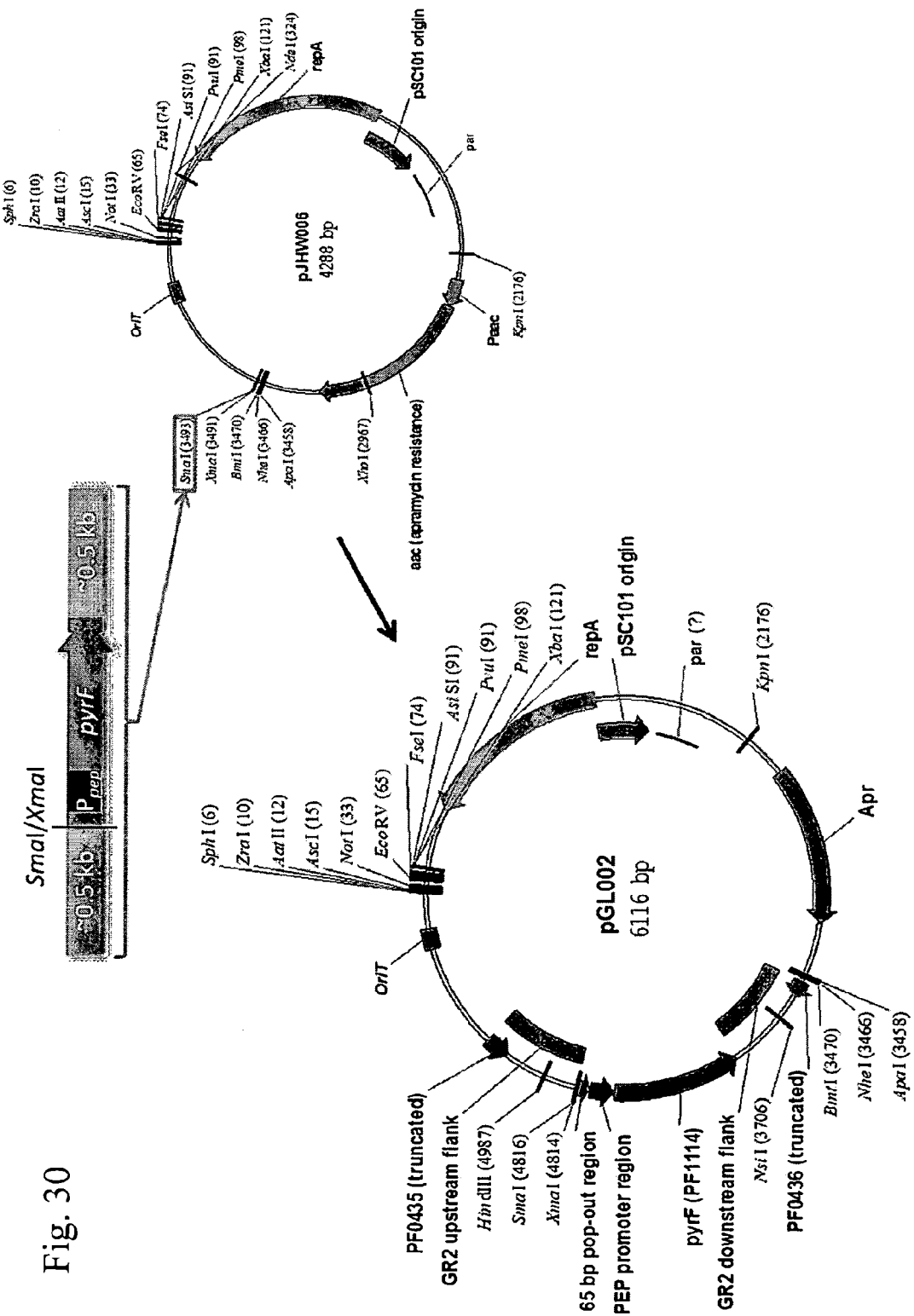
FIG. 30. Construction of pGL002 vector targeting genome region 2.
Figure 31:
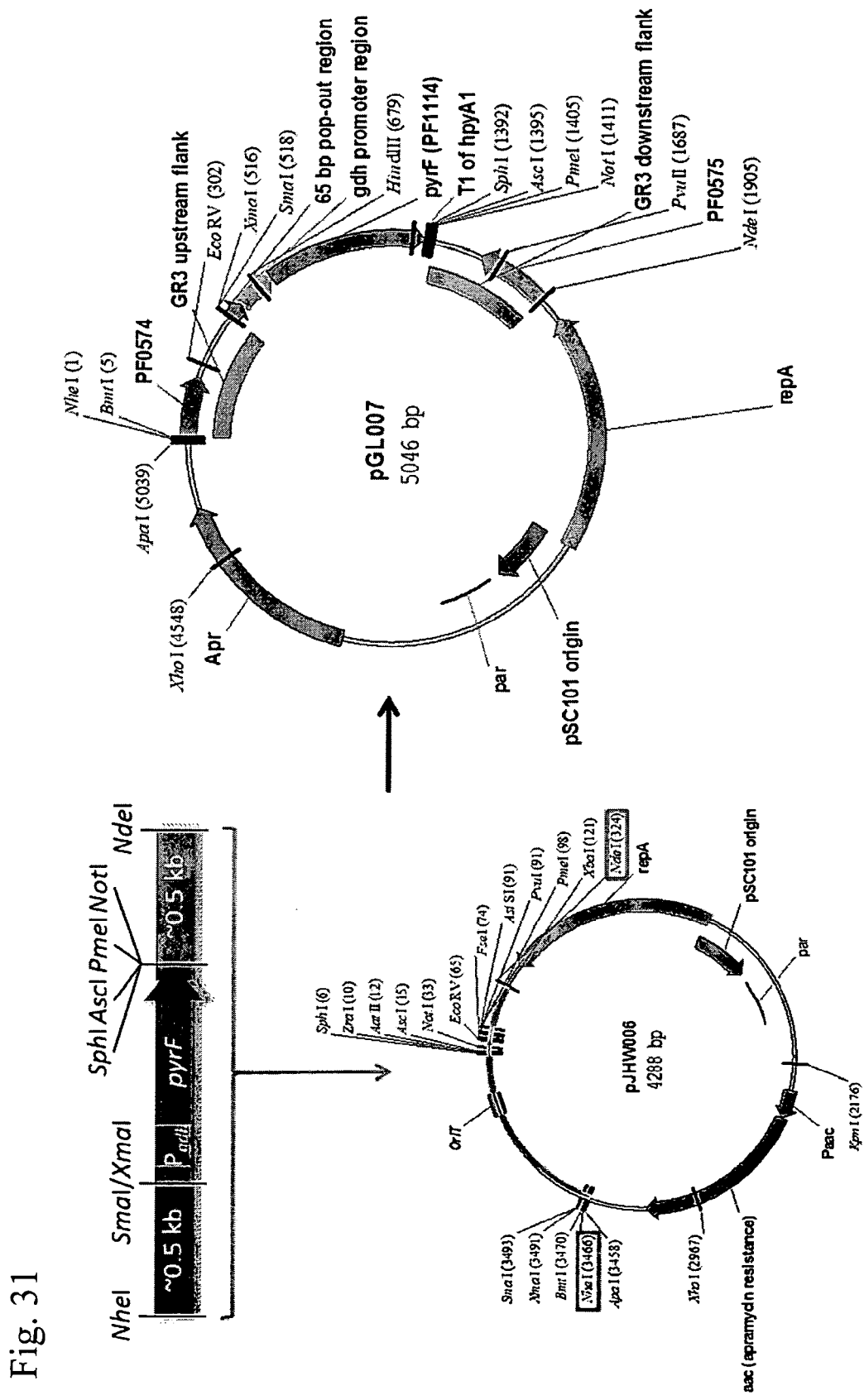
FIG. 31. Construction of pGL007 vector targeting genome region 3.

Construction of vectors targeting insertion at genome regions 2 and 3. SOE-PCR (splicing by overlap extension and PCR, Horton, et al. 1989) was used to combine ~0.5 kb flanking regions targeting homologous recombination at genome region 3 (between convergent genes PF0574-PF0575, see FIG. 28), with a marker cassette, including restriction sites for cloning. The marker cassette for uracil prototrophic selection consisted of the pyrF gene driven by either the pep promoter region ($P_{pep}$, 123 bases of DNA sequence immediately upstream from the translation start of the PEP synthase gene, PF0043) or the gdh promoter region ($P_{gdh}$, 157 bases of DNA sequence immediately upstream from the translation start of the glutamate dehydrogenase gene, PF 1602) and terminated with the terminator sequence consisting of 12 bases of the 3' UTR of the hpyA1 gene (5'-aatctttttag (SEQ ID NO:334), PF1722). A 65-b sequence of the 3' end of the marker cassette (5'-ctaaaaaagaatcttgagac-cattccacctcctcgaaaatcttcttagcggcttccc (SEQ ID NO:335)) was repeated at the beginning of the cassette to serve as a homologous recombination region for selection of marker removal from the transformed strain which would allow for iterative use of the marker in the same strain (Farkas J, et al. Appl Environ Microbiol. 2012. 78(13):4669-76) (FIG. 29). Vector pGL002, targeting genome region 2, was constructed by cloning the SOE-PCR products into the SmaI site of pJHW006 (FIG. 30), and vector pGL007 targeting genome region 3 was constructed by cloning the SOE-PCR product into the NdeI-NheI sites of pJHW006 (FIG. 31) (Lipscomb, et al., *Appl Environ Microb* 77:2232-2238 (2011)).

Figure 32:
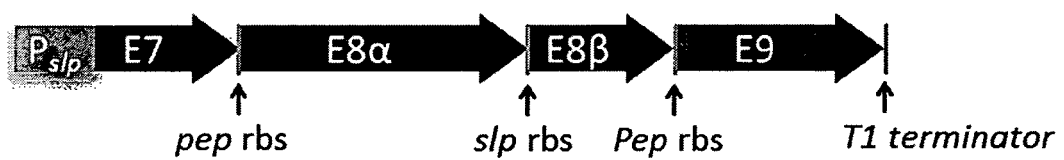
FIG. 32. SP2B expression cassette for cloning into pGL002. The sequence of $P_{slp}$-E7-E8α-E8β-E9γ expression cassette cloned into the SmaI site of pGL002 is disclosed in Kelly et al. (WO 2013/067326).
Figure 33:
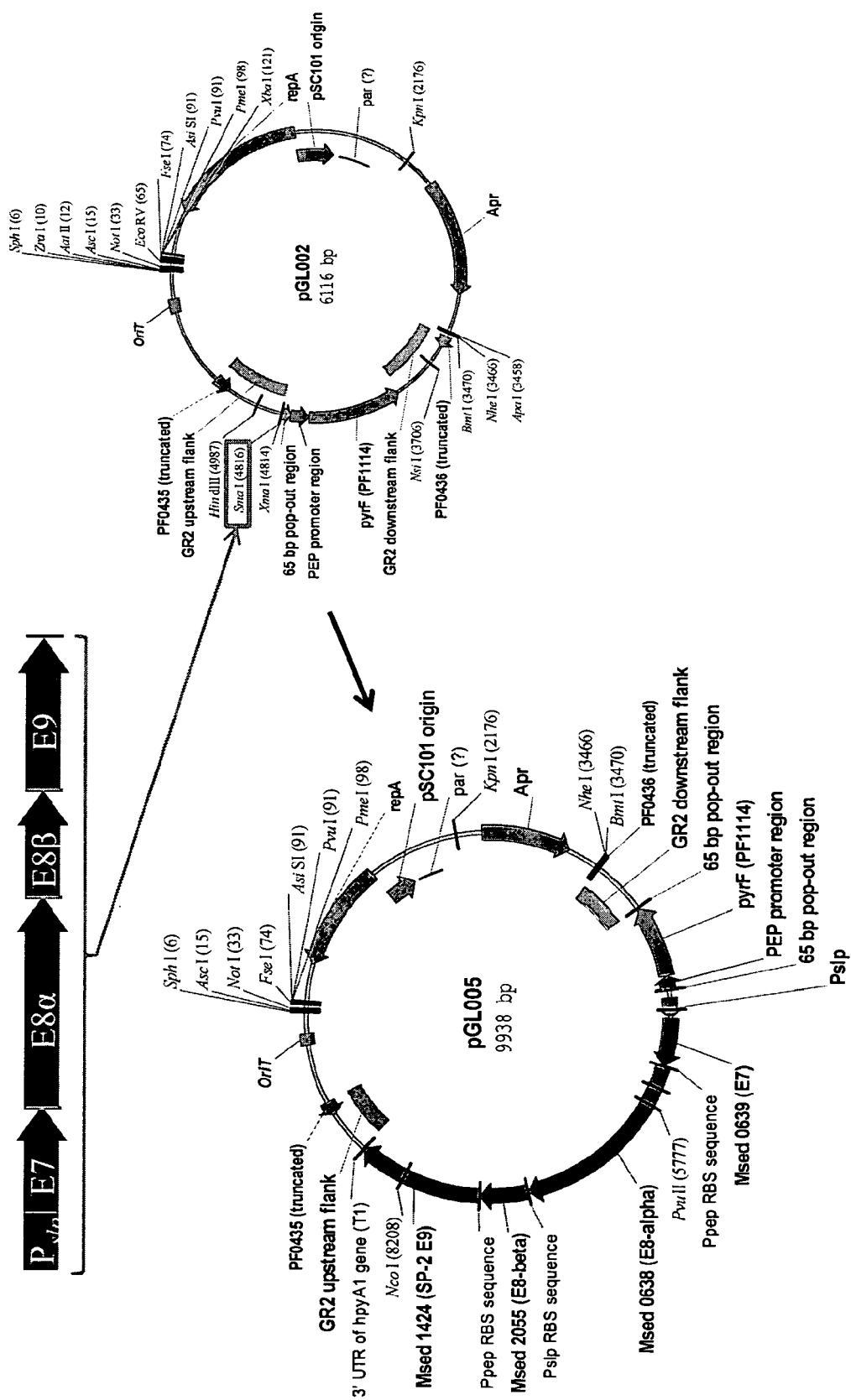
FIG. 33. Construction of pGL005 vector for transformation of *P. furiosus* COM1.

Construction of synthetic operons (SP1 and SP2B) for expression of Msed genes in *P. furiosus*. SOE-PCR was used to construct artificial operons for the co-expression of SP2B genes consisting of the four *M. sedula* genes E7 (Msed_0639), E8α (Msed_0638), E8β (Msed_2055), E9 (Msed1424), with expression driven by the slp promoter region ($P_{slp}$, consisting of 184 bases immediately upstream from the slp gene, PF1399). *P. furiosus* ribosomal binding sites from either the pep gene (5'-ggaggtttgaag (SEQ ID NO:336)) or the slp gene (PF1399, 5'-ggaggtggagaaaa (SEQ ID NO: 337)) were inserted in front of each gene downstream from the first in the operon. A terminator sequence of the hpyA1 gene was included at the end of the operon (5'-aatcttttttatag (SEQ ID NO:338), from the 3' UTR of PF1722) (FIG. 32). The SP2B operon construct was cloned into the SmaI site of pGL002 to make pGL005 for targeted insertion at *P. furiosus* genome region 2 (FIG. 33).

Figure 34:
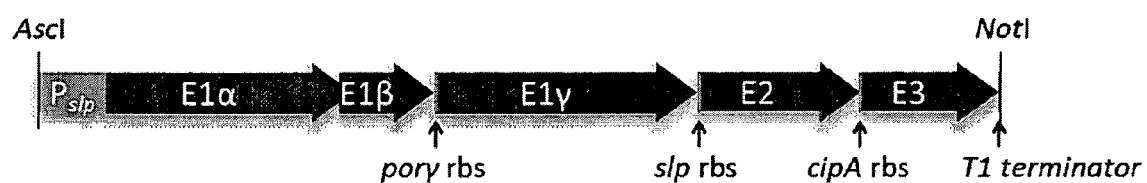
FIG. 34. SP1 expression cassette for cloning into pGL007. The sequence of SP1 expression cassette cloned into pGL007 (genome region 3 insertion vector) to make pGL010) is disclosed in Kelly et al. (WO 2013/067326).
Figure 35:
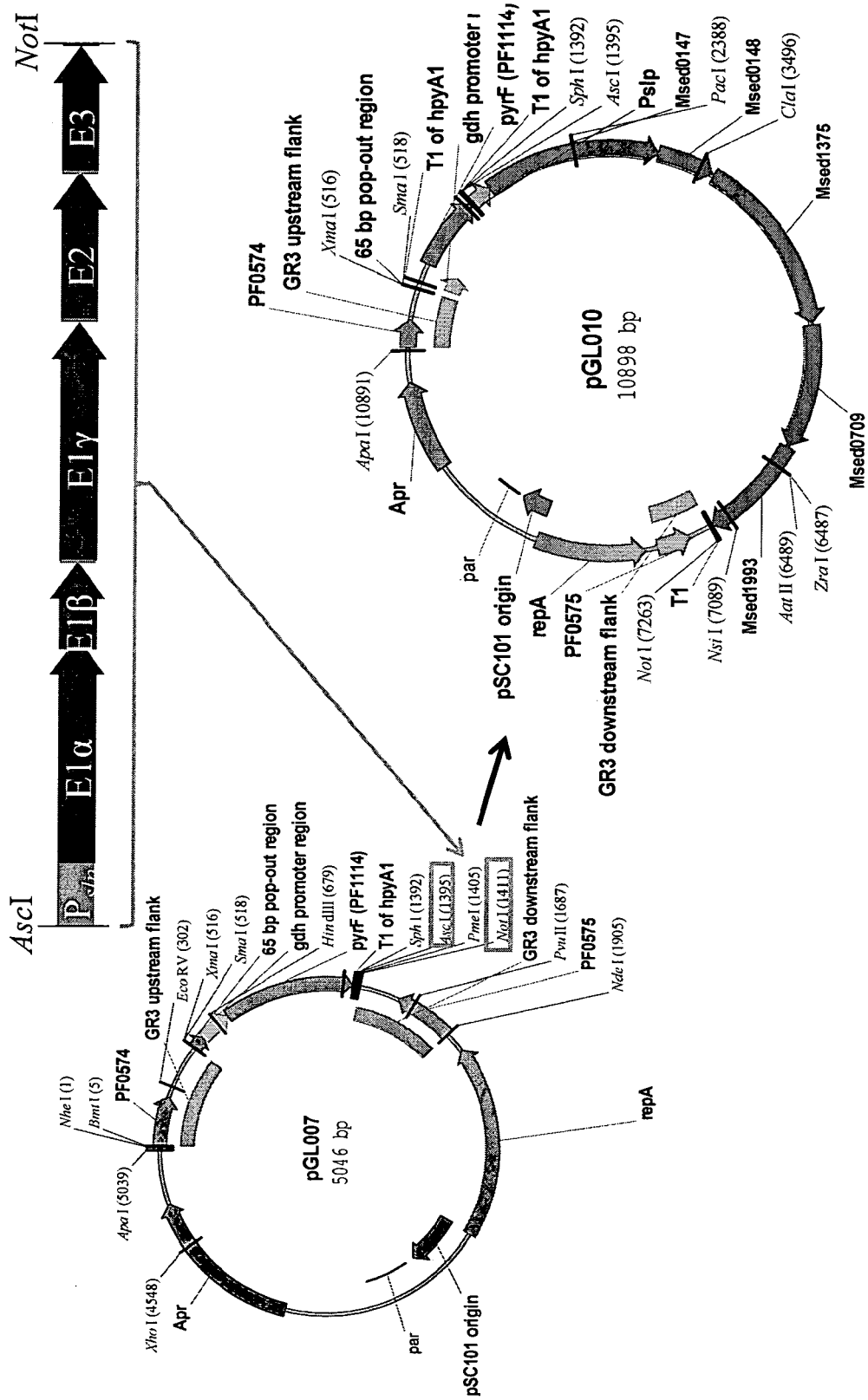
FIG. 35. Construction of pGL010 vector for transformation of COM1.

The expression cassette for SP1 consisting of the five *M. sedula* genes E1α (Msed_0147), E1β (Msed_0148), E1γ (Msed_0149), E2 (Msed_0709), E3 (Msed_1993) was PCR-amplified from pALM506 (FIG. 34). This expression cassette contained ribosomal binding sites from the PORγ gene (PF0791, 5'-ggaggtttgaag (SEQ ID NO:339)), the slp gene (PF1399, 5'-ggaggtggagaaaa (SEQ ID NO:340)), and the cipA gene (PF0190, 5'-ggtgatatgca (SEQ ID NO:341)). A terminator sequence was added to the 3' end of the operon (5'-aatctttttag (SEQ ID NO:342), from the 3' UTR of PF1722), and the construct was cloned into the AscI-NotI sites of pGL007 to make pGL010 (FIG. 35), for targeted insertion at *P. furiosus* genome region 3 (see FIG. 27).

Transformation of *P. furiosus* COM1 strain to yield *P. furiosus* strain MW56 containing SP1 and strain MW43 containing SP2B. Transformation of COM1 was performed as previously described (Lipscomb, et al., *Appl Environ Microb* 77:2232-2238 (2011)), except that linear plasmid DNA was used for transformation. Briefly, pGL010 and pGL005 were linearized by restriction digest and mixed (at a final concentration of ~2 µg/mL DNA) with an aliquot of a freshly grown culture of COM1, cultured in defined cellobiose medium plus 20 µM uracil. Transformation mixtures were spread on defined cellobiose plate medium without uracil and incubated at 95° C. for ~60 h. Transformant colonies were further purified on defined cellobiose plate medium without uracil twice.

Strains were verified by PCR screening of isolated genomic DNA and sequencing of PCR products amplified from the target regions.

EXAMPLE 4

Temperature-Dependent Production of *M. sedula* Enzymes in *P. furiosus* Using Strains PF506 (E1-E3) and MW43 (E9)

Growth of *P. furiosus* for biochemical assays and product analysis. *P. furiosus* strains were cultured in media containing 28 g/L NaCl, 3.5 g/L $MgSO_4$. $7H_2O$, 2.7 g/L $MgCl_2$.$6H_2O$, 0.33 g/L KCl, 0.25 g/L $NH_4Cl$, 0.14 g/L $CaCl_2$.$2H_2O$, 2.00 mg/L $FeCl_3$, 0.05 mg/L $H_3BO_3$, 0.05 mg/L $ZnCl_2$, 0.03 mg/L $CuCl_2$.$2H_2O$, 0.05 mg/L $MnCl_2$.$4H_2O$, 0.05 mg/L $(NH_4)_2MoO_4$, 0.05 mg/L $AlKSO_4$.$2H_2O$, 0.05 mg/L $CoCl_2$.$6H_2O$, 0.05 mg/L $NiCl_2$.$6H_2O$, 3.30 mg/L $Na_2WO_4$.$2H_2O$, 5 g/L maltose and yeast extract, 0.5 µg/L riboflavin, and 20 µM uracil or 4 mM agmatine as needed. After these ingredients are dissolved, the media was made anaerobic by the addition of 0.5 g/L cysteine HCl, 0.5 g $Na_2S$ (dissolved in 50 mL water). Following the reductant 1.0 g/L $NaHCO_3$ was added along with 1 mM potassium phosphate buffer (from a 1 M or 1000× stock at pH 6.8). If needed, the pH of the media was adjusted to 6.8 with HCl before degassing. Cultures were inoculated to $1\times10^7$ cells/mL and incubated at 98° C. until cell densities reached $1\times10^8$ cells/mL Cultures were then cooled at room temperature until the temperature reached 70 to 75° C. when they were placed in an incubator set to a temperature in the range of 65 to 75° C. for up to 32 hours. Cell densities were calculated from counting a sample in a Hausser counting chamber.

*P. furiosus* cell paste was anaerobically resuspended in 50 mM Tris pH 8.0+DNase 1(3 mL buffer/g cell paste). The slurry was stirred for 30 minutes in an anaerobic chamber, lysing the cells by osmotic shock. The crude extract was then centrifuges at 100,000×g for 1 hour. The resulting supernatant (S-100) was diluted (with 50 mM Tris pH 8.0) and re-concentrated 3 times with a 3 kDa centrifugation filter. The washed and concentrated S-100 was sealed in a vial to maintain anaerobicity and stored at −80° C.

Growth of *M. sedula* for biochemical assays and product analysis. *M. sedula* (DSM 5348) was grown autotrophically as described in Example 3.

*M. sedula* cell paste was anaerobically resuspended in 50 mM Tris pH 8.0 and Dnase 1 (2 mL buffer/g cell paste). The slurry was stirred for 1 hour in an anaerobic chamber, lysing the cells by osmotic pressure. The crude extract was then centrifuges at 100,000×g for 1 hour. The resulting supernatant (S-100) was sealed in a vial to maintain anaerobic conditions and stored at −80° C.

Figure 36:
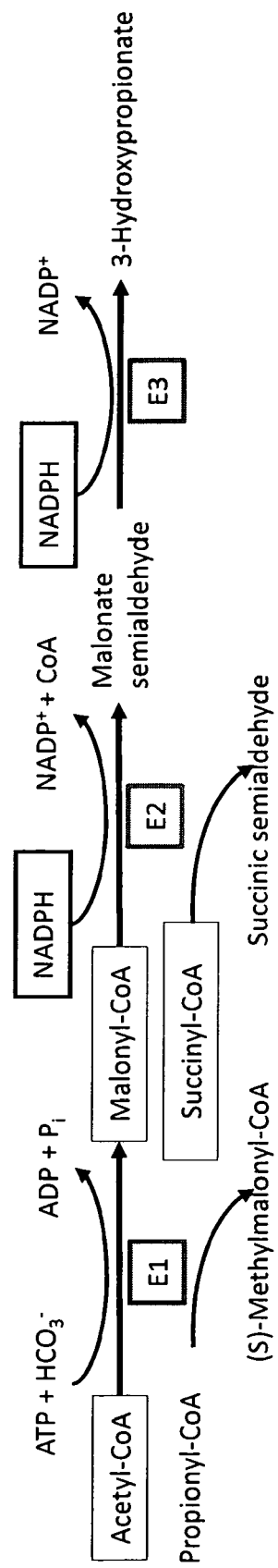
FIG. 36. NADPH-dependent assays for the E2, E2+E3 and E1+E2+E3 reactions of SP1.
Figure 37:
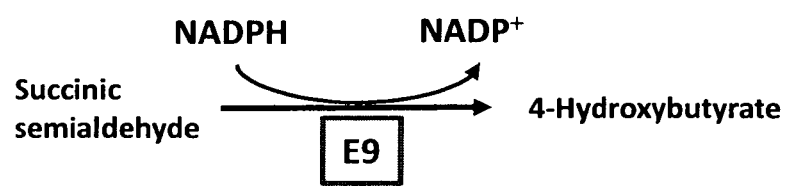
FIG. 37. NADPH-dependent assay for E9 of the SP2B subpathway.

NADPH-dependent assays for the E2, E2+E3 and E1+E2+E3 reactions of SP1 (FIG. 36). All reactions were carried out in sealed anaerobic cuvettes at 75° C. containing 100 mM MOPS pH 7.5 (measured at room temperature), 5 mM $MgCl_2$, 5 mM DTT and the cell-free extract of *P. furiosus* (0.25 mg/ml). After addition of NADPH, the relevant CoA derivative and other substrates (see below), NADPH oxidation was determined by the absorbance at 340 nm and rates were calculated based on the difference before and after the addition of the CoA substrate.

E2 assay. The added substrates were 1 mM NADPH and 1 mM Succinyl-CoA. Note that E3 does not utilize succinic semialdehyde, the product of the reaction.

E2+E3 assay. The added substrates were 1 mM NADPH and 1 mM Malonyl-CoA. In this case E3 does utilize the product, malonate semialdehyde, in a NADPH-dependent reaction.

E1+E2+E3 assay. The added substrates were 1 mM NADPH, 1 mM Acetyl-CoA, 1 mM ATP and 10 mM $NaHCO_3$. The product, malonyl CoA, is then used by E2 and the product of that reaction, malonate semialdehyde, is then used as a substrate for E3, both in NADPH-dependent reactions.

Figure 17:
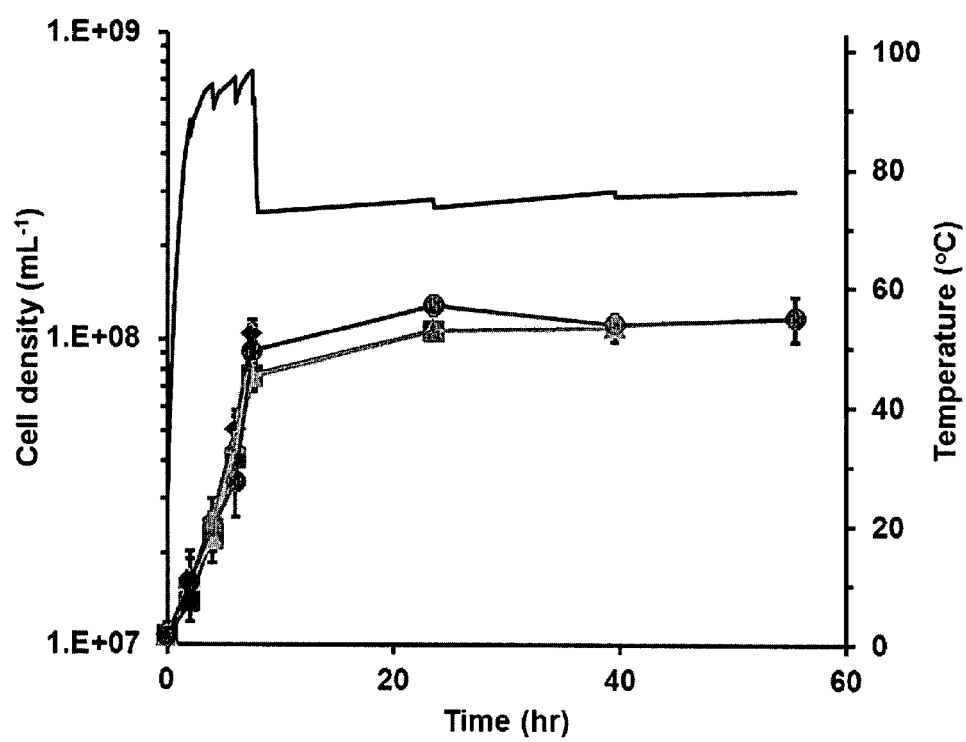
FIG. 17. Growth of P. furiosus strain PF506 at 98° C. and subsequent temperature shift to 75° C. P. furiosus was grown in four 800 mL cultures at 98° C. until the cell density reached $5\times10^8$ cells/mL. The temperature (shown as black line) was then shifted to 75° C. and individual bottles were removed and harvested after 0 (diamond), 16 (square), 32 (triangle) and 48 (circle) hrs. The enzyme activities in each cell type are summarized in FIG. 12B.

The growth of the strain PF505 before and after the temperature shift from 98° C. to 75° C. are shown in FIG. 17. The Specific activities of E1, E2 and E3 in cell-free extracts of PF506 after the temperature shift from 98° C. to 75° C. are shown in Table 9.

Table 9. Specific activities of E1, E2 and E3 in cell-free extracts of PF506 after the temperature shift from 98° C. to 75° C.

| Enzymes | Specific activity: µmol NADPH oxidized/min/mg | | |
|---|---|---|---|
| | E1 + E2 + E3 | E2 + E3 | E2 |
| Substrate | Acetyl-CoA | Malonyl-CoA | Succinyl-CoA |
| ΔPdaD | 0 | 0 | 0 |
| 0 hr | 0.03 | 0.05 | 0.03 |
| 16 hr | 0.03 | 0.54 | 0.16 |
| 32 hr | 0.07 | 0.28 | 0.11 |
| 48 hr | 0.07 | 0.08 | 0.01 |
| Msed | 0.02 | 0.08 | 0.08 |
| Msed (literature)* | 0.07 | 0.42 | 0.20 |

*Published value assayed aerobically at 65° C.: Berg, I. A. et al. 2007. Science. 318, 1782-1786)

The specific activities of E1, E2 and E3 in extracts of PF506 were comparable to those measured in extracts of *M. sedula* and to literature values reported by others after the *P. furiosus* cells were grown for approx. 16 hours at 75° C. No activity was measured in cells grown at 98° C.

NADPH-dependent assay for E9 of the SP2B subpathway (FIG. 36). Assays were carried out in sealed anaerobic cuvettes at 75° C. containing 100 mM MOPS pH 7.5 (measured at room temperature), 5 mM $MgCl_2$, 5 mM DTT, 1 mM NADPH and the cell-free extract of *P. furiosus* (0.25 mg/ml). After addition of 1 mM succinic semialdehyde, NADPH oxidation was determined by the absorbance at 340 nm and rates were calculated based on the difference before and after the addition of the succinic semialdehyde.

Figure 38:
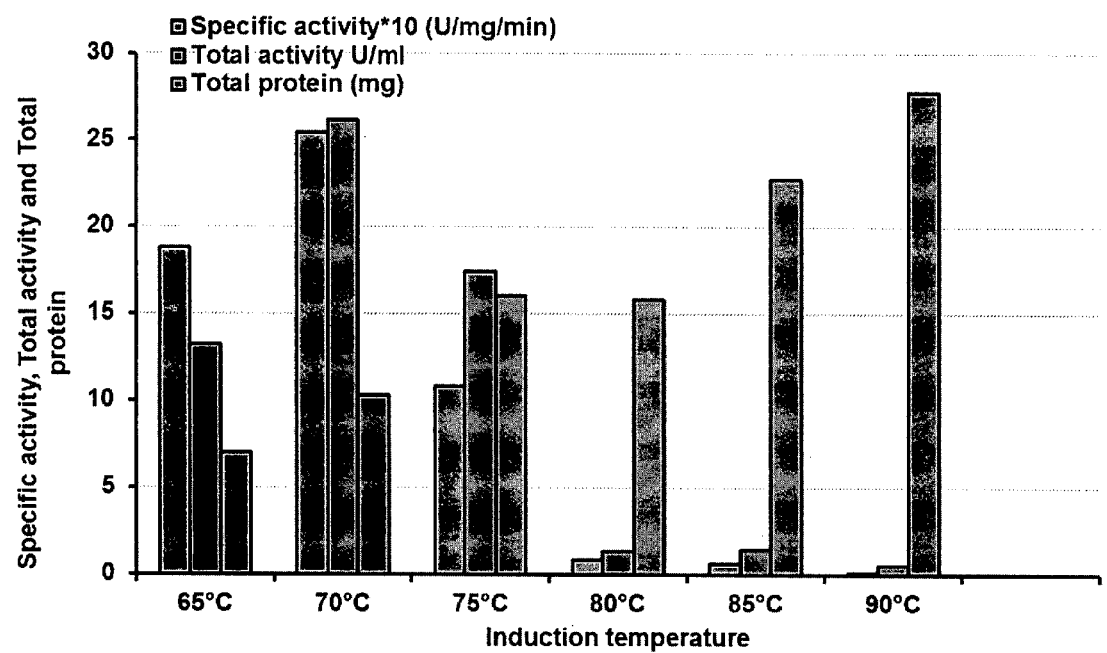
FIG. 38. Growth of *P. furiosus* strain MW43 at 95° C. and temperature shift from 65° C. to 90° C. for 18 hrs.

Growth of P. furiosus strain MW43 at 95° C. and temperature shift from 65° C. to 90° C. for 18 hrs (FIG. 38). Cultures were shifted from 95° C. and were incubated for 18 hr before harvesting. The maximum activity and specific activity for E9 is seen after the cultures are shifted to 70° C. (for 18 hr), with lower values at 65 and 75° C. The production of active E9 decreases dramatically at 80° C. and above.

Figure 39:
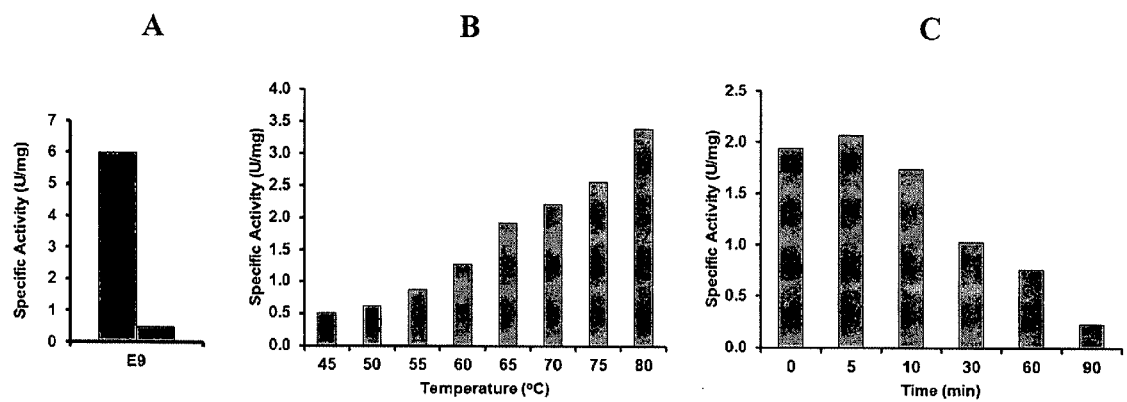
FIG. 39. E9 temperature profile and stability in cell-free extracts of *P. furiosus* strain MW43. A) E9 specific activity in MW43 versus Msed extract. B) E9 specific activity when assayed at increasing temperatures. C) Stability of E9 over time when incubated at 90° C.

E9 temperature profile and stability in cell-free extracts of P. furiosus strain MW43 (FIG. 39). The specific activity of E9 in P. furiosus strain MW43 (grown at 70° C.) is about 10-fold higher that than measured in M. sedula. The highest E9 specific activity was measured in MW43 cells grown at 70° C. even though in cell extracts the maximum activity was above 80° C. and the enzyme has a half-life of ~30 min at 90° C. It was concluded that P. furiosus cells should be temperature shifted from 95-98° C. to 70° C. for 18 hrs to obtain the highest activities of M. sedula enzymes.

EXAMPLE 5

Figure 40:
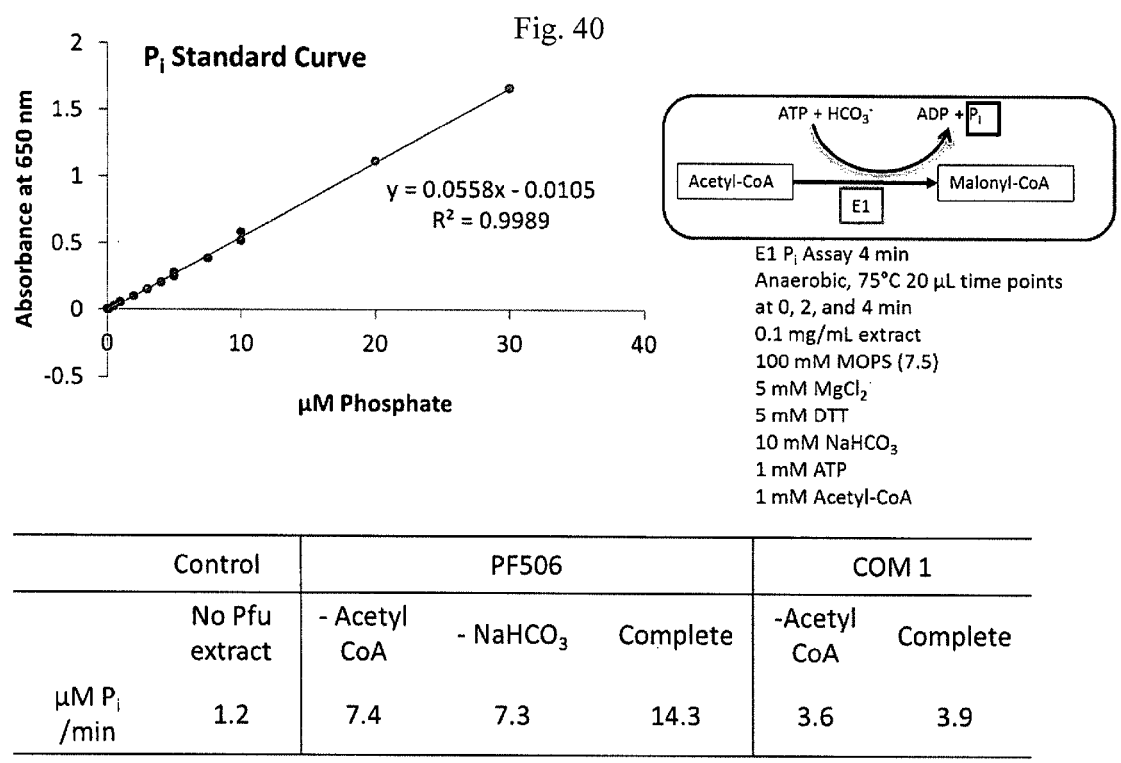
FIG. 40. Phosphate-dependent assay for E1.

Determination of E1 and E2 Activities in P. Furiosus Strain PF506, its Parent Strain ΔPdaD, in P. furiosus Strain MW56 and its Parent Strain COM1, and in M. sedula Phosphate Assay for E1 (FIG. 40). Pf extract was added to 0.1 mg/mL in buffer containing 100 mM MOPS pH 7.5 (at room temperature), 5 mM $MgCl_2$, and 5 mM DTT. Added substrates were 10 mM $NaHCO_3$, 1 mM ATP, and 1 mM Acetyl-CoA. The sealed anaerobic vials were incubated at 75° C. and 20 μL samples were taken out at 0, 2, and 4 minutes and added to a 96 well plate. The samples were diluted with 180 μL of water before the addition of 30 μL of BioVision (Mountain View, Calif.) phosphate assay reagent. Absorbance at 650 nm was measured and rates were calculated based on the difference between the -Acetyl-CoA control for each sample.

Specific activities of E1 and E2 in cell-free extracts of recombinant and parent P. furiosus strains and in M. sedula (Table 10). The E1 and E2 assays were carried out at 75° C. as described in FIGS. 16 and 23, respectively. Specific activities are expressed as nmol phosphate released and nmol NADPH oxidized/min/mg, respectively.

TABLE 10

| Cell-extract | E1: Acetyl-CoA $P_i$ release | E2: Malonyl-CoA NADPH oxidation |
|---|---|---|
| COM 1 | <5 | <5 |
| ΔPdaD | <5 | <5 |
| MW56 | 93 ± 10 (n = 4) | 92 (n = 1) |
| PF506 | 74 ± 19 (n = 6) | 248 ± 123 (n = 11) |
| Msed | 206 ± 49 (n = 3) | 143 ± 60 (n = 3) |

The specific activities of E1 and E2 in P. furiosus strains PF506 and MW56 are comparable to those measured in Msed but are not detected in the P. furiosus parent strains.

EXAMPLE 6

Production of 3HP by Cell-Free Extracts of P. furiosus Strains PF506 and MW56

Identification and quantitation of 3-hydroxypropionate produced by the SP1 pathway in cell-free extracts of P. furiosus strain PF506 and strain MW56. Two approaches were used to produce 3HP: 1. Using malonyl CoA with NADPH or $H_2$/NADP as the electron donor catalyzed by enzymes E2+E3 (and SHI to activate $H_2$); and 2. Using acetyl CoA plus $CO_2$ (bicarbonate) with NADPH or $H_2$/NADP as the electron donor catalyzed by enzymes E1+E2+E3 (and SHI to activate $H_2$).

Detection and quantitation of 3-hydroxypropionate (3HP). 3HP produced in cell-free extracts of P. furiosus was derivatized by two reactions and each derivative was identified and quantitated by different approaches.

HPLC: 2-Nitrophenylhydrazine derivatization. The 3HP-hydrazide was prepared and extracted from mixtures with ether. The ether-extracted 3HP-hydrazide was identified by ESI-MS analysis. The ether-extracted 3HP-hydrazide was quantitated after separation by HPLC.

GC-MS: per-O-trimethylsilylate derivatization. The 3HP-TMS derivative was both identified and quantitated using GC-MS analysis.

Methods used to identify 3-HP in cell-free extracts of P. furiosus. Production of 3-HP from malonyl CoA by E2+E3 and from acetyl CoA by E1+E2+E3. To the Pf extract (0.25 mg/mL) in buffer containing 100 mM MOPS pH 7.5, 5 mM $MgCl_2$, and 5 mM DTT, was added 1-2 mM Malonyl-CoA (for E2+E3) or 10 mM $NaHCO_3$, 2 mM ATP and 1 mM Acetyl-CoA (for E1+E2+E3). The electron source was 2 mM NADPH or 0.5 mM $NADP^+$ with 100% $H_2$ in the headspace. Sealed anaerobic vials were incubated at 75° C. for up to 2 hours.

GC-MS detection of 3-HP. A sample of the enzyme assay mixture was spiked with 20 μg of inositol as an internal standard. For hydrolysis of proteins, the samples were freeze-dried, then incubated in 2 M TFA at 80° C. for 1 hour then dried under nitrogen. The samples were then per-O-trimethylsilylated by treatment with Tri-Sil (Pierce) at 80° C. for 30 minutes. GC-MS analysis of the TMS derivatives was performed on an AT 7890n GC interfaced to a 5975C MSD, using a Grace EC-1 column (30 m×0.25 mm) The exact mass of 3-HP-TMS is 162.

2-Nitrophenyl hydrazine derivatization of 3HP. The steps to derivatize 3HP were as follows. 1) Add 100 μL sample of cell-free extract to 200 μL ethanol. 2) Add 200 μL 20 mM 2-nitrophenyl hydrazine in 100 mM HCL/ethanol (1:1). 3) Add 200 μL 250 mM 1-Ethyl-3-(3-Dimethylaminopropyl)-N'-ethylCarbodiimide hydrochloride (1-EDC.HCL) in 3% pyridine in ethanol (v/v). 4) Heat sample at 60° C. for 20 minutes. 5) Add 100 μL of 15% (W/V) KOH. 6) Heat again at 60° C. for 15 minutes. 7) Let sample cool and acidify with 50% HCL to pH between 4-6. 8) Analyze 10-50 μL aliquots on the HPLC.

Ether extraction of 3HP-Hydrazide. This was accomplished by the following steps. 1) Add 1 mL 1 M $KPO_4$ Buffer, pH 7.0 to cooled 800 μL derivatized sample. 2) Add 1 mL of ether to sample and mix well. 3) Centrifuge 10 min 6,000 g to separate the phases. 4) Remove top ether layer and transfer to a new tube. 5) Repeat steps 2-4. 6) Evaporate the ether. 7) Suspend the dried sample in 200 μL methanol or 0.05% TFA. 8) Run 10-50 μL aliquots on the HPLC.

HPLC detection of 3-HP-Hydrazide. The column and run conditions were as follows: column, Supelco LiChrosorb RP-8 (5 μm); solvent system, A 0.05% TFA, B 100% acetonitrile; gradient 0-20 min, 0-100% B, 20-22 min: 100% B; flow rate: 1 ml/min; temperature: 30° C.

ESI-MS detection of 3-HP-hydrazide. The derivatized 3HP samples were extracted with ether, dried, and re-constituted in methanol. The resulting samples were analyzed by direct injection on a Perkin-Elmer API 1 plus in negative mode. The exact mass of the anion 3HP-Hydrazide is 224.

Summary of methods used to identify 3-HP in cell-free extracts of *P. furiosus* is shown in Table 13. Summary of amounts of 3-HP produced by cell-free extracts of PF506 and MW56 using malonyl CoA (E2+E3) or acetyl CoA+$CO_2$ (E1+E2+E3) as the carbon sources with NADPH or $H_2$ as the electron donor is shown in Table 11 and Table 12

TABLE 11

| Strain | E2 + E3: 1 mM Malonyl-CoA | | E1 + E2 + E3: 1 mM Acetyl-CoA | |
|---|---|---|---|---|
| | NADPH e⁻ donor (2 mM) | $H_2$ e⁻ donor (100% headspace) | NADPH e⁻ donor (2 mM) | $H_2$ e⁻ donor (100% headspace) |
| MW56 | HPLC | (not done) | HPLC | HPLC |
| PF506 | HPLC GC-MS ESI-MS | GC-MS | HPLC ESI-MS | ESI-MS |

TABLE 12

| P. furiosus strain | E2 + E3: 1 mM Malonyl-CoA | | E1 − E2 + E3: 1 mM Acetyl-CoA | |
|---|---|---|---|---|
| | NADPH e⁻ donor (2 mM) | $H_2$ e⁻ donor (100% headspace) | NADPH e⁻ donor (2 mM) | $H_2$ e⁻ donor (100% headspace) |
| MW0056 | 100 μM/ 30 min (C) | (not done) | 40 μM/ 8 min (D) | 48 μM/ 8 min (D) |
| PF506 | 160 μM/ 2 hr (A) 500 μM/ 2 hr (B) 80 μM/ 30 min (C) | 150 μM/ 2 hr (A) | 50 μM/ 2 min (D) | 23 μM/ 2 min (D) |

TABLE 13

| | A | B | C | D |
|---|---|---|---|---|
| Method | GC-MS | HPLC | HPLC | HPLC |
| [Protein] | 0.25 mg/mL | 0.25 mg/mL | 0.3 mg/mL | 3 mg/mL |

EXAMPLE 7

Production of 3HP by Whole Cells of *P. furiosus* Strains PF506 and MW56

Product Analysis of E1+E2+E3 Activities in Whole Cells of *P. furiosus*.

Figure 41:
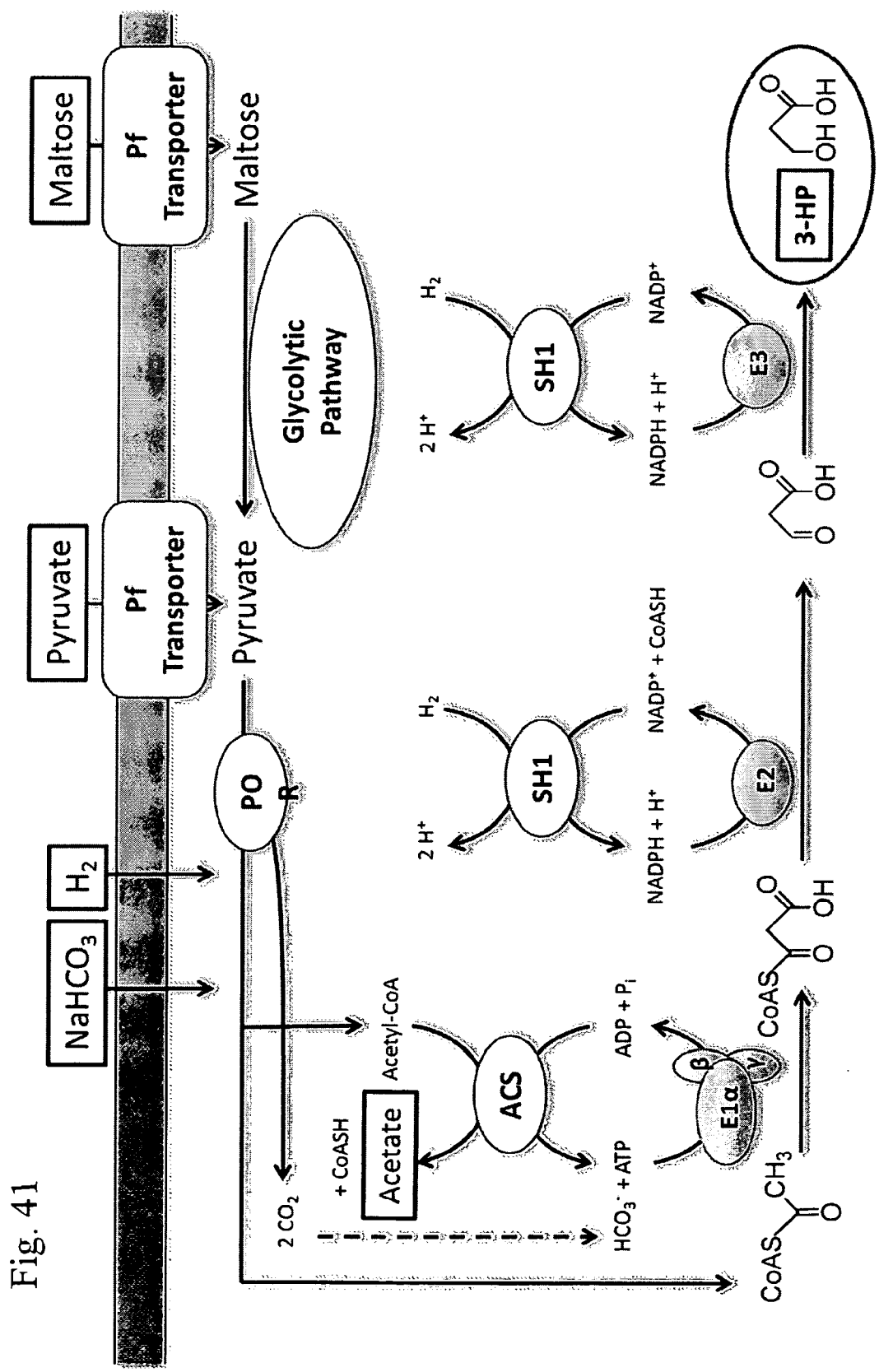
FIG. 41. Scheme for producing acetyl CoA from pyruvate or maltose and for producing ATP and NADPH for the SP1 pathway for 3-HP production by whole cells of *P. furiosus* strains PF506 and MW56.

In vivo 3-HP production assay. PF506 and MW56 were grown in 2 L cultures at 98° C. for 10 hours until cell densities reached $1 \times 10^8$ cells/mL when they were cooled and incubated at 75° C. for 16 hours. Harvested cells were suspended to $5 \times 10^{10}$ cells/mL in 100 mM MOPS pH 7.5 and 1×Pf base salts (28 g/L NaCl, 3.5 g/L $MgSO_4 \cdot 7H_2O$, 2.7 g/L $MgCl_2 \cdot 6H_2O$, 0.33 g/L KCl, 0.25 g/L $NH_4Cl$, 0.14 g/L $CaCl_2 \cdot 2H_2O$). The cell suspension was sealed in a serum vial, degasses with Ar, and brought to 0.5 g/L cysteine HCl. Added substrates were 10 mM $NaHCO_3$ and either 10 mM maltose or 40 mM pyruvate. The vials were then degassed with $H_2$ and incubated at 75° C. for 60 minutes. Samples for 3-HP analysis by HPLC include a direct sample of the cell suspension, the supernatant of a portion, and the pellet re-suspended and lysed in water. A schematic of how *P. furiosus* metabolizes maltose and provides acetyl CoA for 3HP production is shown at FIG. 41.

A total of 135 μM of 3HP was produced by a cell suspension of MW56 ($5 \times 10^{10}$ cells/ml) after 60 min at 75° C. A total of 199 μM of 3HP was produced by a cell suspension of PF506 ($5 \times 10^{10}$ cells/ml) after 60 min at 75° C. 3-HP production by whole cells of *P. furiosus* strains PF506 and MW56 is summarized in Table 14. The majority (~70%) of in vivo produced 3-HP was contained within intact cells.

TABLE 14

| 1 mL cell suspension | MW56 | | PF506 | | |
|---|---|---|---|---|---|
| | Pyruvate | Maltose | Pyruvate | Maltose | No Substrate |
| Extracellular | 45 nmol | 30 nmol | <20 nmol | 45 nmol | <20 nmol |
| Intracellular | 110 nmol | 80 nmol | 50 nmol | 100 nmol | <20 nmol |

EXAMPLE 8

Anapleurosis and Assimilation of Acetyl-CoA Associated with $H_2$—$CO_2$ Autotrophy in the Thermoacidophilic Archaeon *Metallosphaera Sedula*

Figure 42:
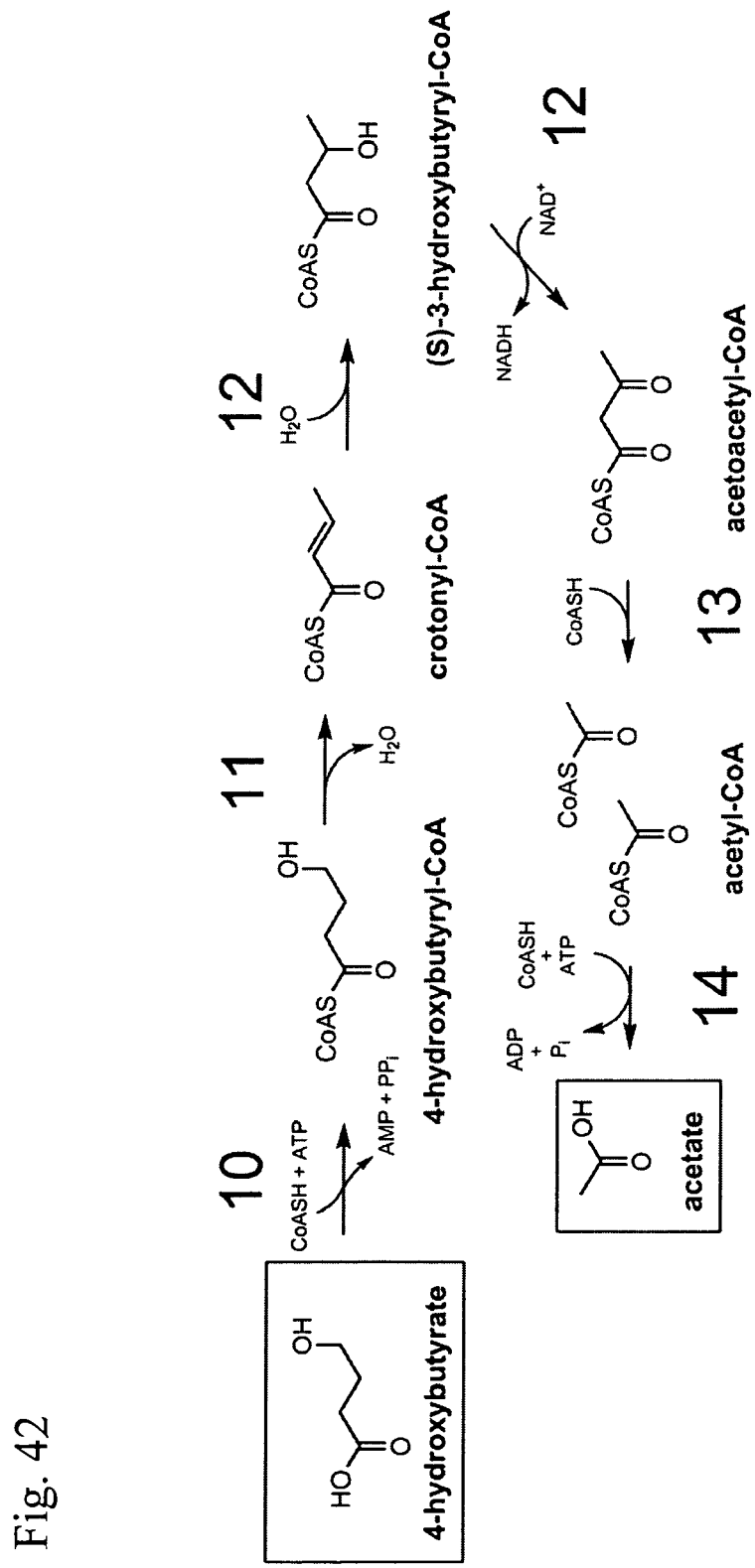
FIG. 42. Enzymes and substrates in final reactions of 3HP/4HB cycle in *M. sedula*. Enzymes: 10, 4-hydroxybutyrate-CoA synthetase; 11, 4-hydroxybutyryl-CoA dehydratase; 12, crotonyl-CoA hydratase/(S)-3hydroxybutyryl-CoA dehydrogenase; 13, acetoacetyl-CoA β-ketothiolase; 14 acetyl-CoA synthetase (non-native, used for HPLC assay).

*Metallosphaera sedula* is an extremely thermoacidophilic archaeon ($T_{opt}$=73° C., pH 2.0) that grows heterotrophically on peptides and chemolithoautotrophically on metal sulfides or hydrogen gas (Auernik and Kelly, 2010, Appl. Environ. Microbiol. 76:931-935). For chemolithotrophic growth it uses a unique carbon fixation pathway, known as the 3-hydroxypropionate/4-hydroxybutyrate (3HP/4HB) cycle (Berg et al., 2007. Science 318:1782-1786), so far found only in members of the order Sulfolobales. This cycle is one of two such cycles found exclusively in thermophilic archaea, the other being the dicarboxylate/4-hydroxybutyrate (DC/4HB) cycle present in the order Desulfurococcales (Berg et al., 2010. Nat. Rev. Microbiol. 8:447-460). In the first part of the 3HP/4HB cycle, acetyl-CoA (C2) is converted into succinyl-CoA (C4) by two successive carboxylation steps (Berg et al., 2010. Nat. Rev. Microbiol. 8:447-460). Succinyl-CoA is then converted to 4HB, which is rearranged and cleaved to produce two molecules of acetyl-CoA. Labeling studies using 4-hydroxy[1-$^{14}C$]butyrate and [1,4-$^{13}C_1$]succinate revealed how the 3HP/4HB pathway relates to *M. sedula* central metabolism (Estelmann et al., 2011. J. Bacteriol. 193:1191-1200), suggesting that most of the carbon flux (about two-thirds) enters central metabolism via succinate ('succinate branch') and not through reductive carboxylation of acetyl-CoA to pyruvate. The remaining third of the carbon flux ('acetyl-CoA branch') passes through 4HB, thereby regenerating acetyl-CoA (FIG. 42).

Transcriptomic analysis of *M. sedula* cells grown under strictly autotrophic conditions ($H_2$, $CO_2$) presented here supports the premise that most carbon is assimilated via succinate and provides additional insights into the connections between the carbon fixation and central metabolism. This analysis indicates that acetyl-CoA assimilation occurs during formation of citric acid cycle intermediates (e.g., citrate and malate) and also during isoprenoid-based lipid biosynthesis (Koga and Morii, 2007. Microbiol. Mol. Biol. Rev. 71:97-120; Boucher et al., 2004. Molecular Microbiology 52:515-527). Thus, the six enzymes in the acetyl-CoA branch of the 3HP/4HB cycle, which catalyze the rearrangement of succinyl-CoA to acetoacetyl-CoA with subsequent cleavage to acetyl-CoA, are essential not only for $CO_2$ fixation but also for anaplerosis of acetyl-CoA.

Most of the individual enzymes of the 3HP/4HB cycle have now been characterized biochemically, including methylmalonyl-CoA mutase (Msed_0639) and epimerase (Msed_0638, Msed_2055) (Han et al., 2012. Appl. Environ. Microbiol. 78:6194-6202), and acyl-CoA synthetase (Msed_0406) that catalyzes the ligation of 4HB to CoA (Example 1) (Table 1). Here, we report the biochemical characteristics of two more enzymes of the 3HP/4HB pathway—4-hydroxybutyryl-CoA dehydratase (4hbd) (Msed_1321) and β-ketothiolase (Thl) (Msed_0656). Furthermore, the final part of the 3HP/4HB cycle was re-constituted in vitro to produce acetyl-CoA from 4HB, demonstrating that these enzymes are likely involved in the functioning cycle. Finally, biochemical and transcriptomic information was used to examine the connection of the 3HP/4HB cycle to central metabolism in *M. sedula*.

Materials and Methods

Growth of *M. sedula* in a gas-intensive bioreactor. *M. sedula* (DSMZ 5348) was grown aerobically on DSMZ medium 88 at pH 2.0 in a 70° C. shaking oil bath. For routine small cultures (30 ml), heterotrophically grown cells were supplemented with 0.1% tryptone, while autotrophically grown cells were grown with the addition of 50 ml gas mix to the headspace (80% $H_2$, 20% $CO_2$). Cell growth was scaled-up from 300 ml in sealed 1-liter bottles to 2 liters in a stirred bench-top glass fermentor (Applikon), agitated at 250 rpm. Two separately regulated gas feeds were used—one for $H_2/CO_2$ mixture and one for air. The flow rates were held constant for all conditions at 1 ml/min for the $H_2/CO_2$ gas mixtures (composition: varied) and 100 ml/min for air (composition: 78% $N_2$, 21% $O_2$, 0.03% $CO_2$). The gas mixture compositions were as follows: autotrophic carbon-rich (ACR)—80% $H_2$ and 20% $CO_2$; autotrophic carbon limited (ACL)—80% $H_2$ and 20% $N_2$; and heterotrophic (HTR)—80% $N_2$ and 20% $CO_2$ (with 0.1% tryptone added to medium). Tandem bioreactors were run simultaneously and started with the same inoculum to generate biological repeats. Cells were harvested at mid-exponential phase by rapid cooling with dry ice and ethanol and then centrifuged at 6000×g for 15 min at 4° C.

*M. sedula* oligonucleotide microarray transcriptional response analysis. A spotted whole-genome oligonucleotide microarray was used for transcriptional analysis, as described in Example 1. Total RNA was extracted and purified using an RNeasy kit (Qiagen), reverse-transcribed with Superscript III (Invitrogen), re-purified, and labeled with either Cy3 or Cy5 dye (GE Healthcare). Labeled cDNA was then hybridized to the microarray slide (Corning) at 42° C. Slides were scanned on a GenePix 4000B Microarray Scanner (Molecular Devices, Sunnyvale, Calif.) and raw intensities were quantitated using GenePix Pro version 6.0. Data normalization and statistical analysis were performed using JMP Genomics 5 (SAS, Cary, N.C.). In general, significant differential transcription was defined to be relative changes in expression of ≥2-fold (where a $\log_2$ value of ±1 means a 2-fold change) having p values of ≥5.4 (Bonferroni correction equivalent to a p value of $4.0 \times 10^{-6}$ for this microarray). Microarray data are available through the NCBI Gene Expression Omnibus (GEO) under accession number GSE39944.

Heterologous expression of *M. sedula* genes in *E. coli*. Msed_0406, Msed_1321, Msed_0399, and Msed_0656 were amplified from genomic DNA using primers from IDT Technologies (Coralville, Iowa). Msed_0406 was cloned into pET46-Ek/LIC with an N-terminal $His_6$ tag, as described in Example 1. Msed_1321 was cloned with an N-terminal $His_6$ tag into a modified pETA vector, into which the anaerobic hya promoter from *E. coli* had been inserted to allow for anaerobically-regulated expression (Sun et al., 2010. PLoS One 5:e10526). Msed_0399 was cloned into pET21b without a His-tag, and Msed_0656 was cloned into pCDF-Ek/LIC with an N-terminal $His_6$ tag. All four constructs were individually cloned into NovaBlue GigaSingles *E. coli* competent cells and selected by growth on LB-agar supplemented with antibiotic. Sequences were confirmed by Eton Biosciences, Inc. (Durham, N.C.). Next, the plasmids were transformed into *E. coli* Rosetta 2 (DE3) cells for protein expression. Rosetta strains containing pET46-0406, pET21b-0399, and pCDF-0656 were grown and expressed aerobically at 37° C. for 16 h in Studier's auto-inducing medium ZYM-5052 (Studier, 2005. Protein Expression and Purification 41:207-234). Rosetta cells containing pETA-1321 plasmid were grown in a 2 L Applikon bioreactor (37° C., 800 rpm, pH 6.7, 0.5 slpm air) in Studier's non-inducing medium ZYM-505 with 0.5 mM $FeCl_3$. Cells were grown until dissolved oxygen reached ~30% of the initial level, at which point 50 mM glucose was added and the air feed was switched to $N_2$ to induce anaerobic expression. The cells were grown for another three hours before harvest.

Enzyme purification and biochemical assays. Lysis of aerobically expressed proteins began with harvesting cells and centrifuging at 6000×g for 15 min at 4° C. Cell pellets were re-suspended in lysis buffer (50 mM sodium phosphate, 100 mM NaCl, 0.1% Nonidet P-40, pH 8.0) and lysed with a French pressure cell (two passes at 18,000 psi). The lysate was centrifuged at 25,000×g for 15 min at 4° C. to remove insoluble material. Native *E. coli* proteins were removed by heat-treating the extract at 65° C. for 20 minutes. Nucleic acids were precipitated by addition of streptomycin sulfate (1% w/v), and then lysate was centrifuged again at 25,000×g for 15 min at 4° C. to remove precipitated nucleic acids and heat-labile proteins. The soluble, heat-treated cell-free extract was sterile-filtered (0.22 μm) before chromatographic purification. Msed_1321 was lysed and purified in a Coy anaerobic chamber (95% $N_2$, 5% $H_2$). The cell pellet was re-suspended in lysis buffer (20 mM Tris, 20 mM NaCl, 3.5 mM DTT, 1 mg/ml lysozyme, pH 8.0) and incubated for 30 min at 37° C., followed by heat-treatment at 65° C. for 30 min. Streptomycin sulfate (1% w/v) was added and the lysate was centrifuged at 25,000×g for 15 min at 4° C. The soluble, heat-treated cell-free extract was sterile-filtered (0.22 μm) before purification by column chromatography.

4-hydroxybutyrate:CoA ligase (Msed_0406) and acetoacetyl-CoA β-ketothiolase Msed_0656—These enzymes were purified using a 1 ml HiTrap nickel column (GE Healthcare). The soluble, heat-treated lysate was loaded onto the column with binding buffer (50 mM sodium phosphate, 300 mM NaCl, 20 mM imidazole, pH 7.4) and the his-tagged enzyme removed with elution buffer (50 mM sodium phosphate, 300 mM NaCl, 500 mM imidazole, pH 7.4). The elution fractions containing enzyme were collected, concentrated, and dialyzed into reaction buffer (100 mM MOPS, pH 7.5), and then either stored at 4° C. for immediate use or mixed with glycerol to 20% and stored at −20° C. For 4-hydroxybutyrate:CoA synthetase (Msed_0406), a discontinuous assay was used to measure substrate-dependent disappearance of CoA at 70° C. using 5,5′-dithiobis-(2-nitrobenzoic acid) (DTNB), as described in Example 1. For acetoacetyl-CoA β-ketothiolase (Msed_0656), enzyme activity was measured using the discontinuous DTNB assay to measure substrate-dependent disappearance of CoA at 70° C. The reaction buffer contained 20 mM MOPS, pH 7.5, 5 mM $MgCl_2$, 0.2 mM CoA, 0.3 mM acetoacetyl-CoA, and purified enzyme.

Crotonyl-CoA hydratase/(S)-3-Hydroxybutyryl-CoA dehydrogenase (Msed_0399). The enzyme was purified first using a Q-sepharose HiLoad 16/10 anion exchange column (GE Healthcare). The protein was loaded onto the column with 20 mM Tris, pH 8.0, and eluted with 20 mM Tris, 1 M NaCl, pH 8.0 using a linear elution gradient. Fractions containing Msed_0399 were confirmed with SDS-PAGE, collected and dialyzed into buffer for size exclusion chromatography (50 mM potassium phosphate, 150 mM NaCl, pH 7.0). The partially-purified protein was further separated on a HiLoad 26/600 Superdex 200 PG column, and the elution fractions containing Msed_0399 were collected, concentrated, and dialyzed into reaction buffer (100 mM MOPS, pH 7.5), and then either stored at 4° C. for immediate use or mixed with glycerol to 20% and stored at −20° C. Enzyme activity was measured spectrophotometrically at 70° C. by following $NAD^+$ reduction at 340 nm (extinction coeffienct at 340 nm=3,400 $M^{-1}$ $cm^{-1}$) (Berg et al., 2007. Science 318:1782-1786). The assay mixture contained 20 mM MOPS (pH 7.0), 5 mM $MgCl_2$, 2 mM $NAD^+$, 0.5 mM crotonyl-CoA or (S)-3-hydroxybutyryl-CoA, and purified enzyme. The reaction mixture was preheated for 2 min at 70° C. and the reaction initiated by addition of substrate.

4-hydroxybutyryl-CoA dehydratase (Msed_1321). The enzyme was purified using a 5 ml Bio-Scale Mini Profinity IMAC cartridge (Bio-Rad). The soluble, heat-treated lysate was loaded onto the column with binding buffer (50 mM Tris, 300 mM NaCl, 3.5 mM DTT, 20 mM imidazole, pH 8.0) and the his-tagged enzyme removed with elution buffer (50 mM Tris, 300 mM NaCl, 3.5 mM DTT, 500 mM imidazole, pH 8.0). The fraction collector was positioned inside the anaerobic chamber, and fractions containing enzyme were collected, concentrated, and dialyzed into reaction buffer (100 mM potassium phosphate, pH 7.5, 1 mM DTT). The enzyme solution was either stored at room temperature inside the anaerobic chamber for immediate use or mixed with glycerol to 20% and stored at −20° C. in a sealed vacuum dessicator. Enzyme activity was measured aerobically in a coupled spectrophotometric assay at 70° C. The assay mixture contained 20 mM sodium phosphate, 5 mM $MgCl_2$, 2 mM 4HB, 2 mM ATP, 1 mM CoA, 2 mM $NAD^+$, 1 mM DTT, 1 mg/ml purified Msed_0406, and 42 ng/ml Msed_0399. The reaction mixture was pre-heated for 5 min at 70° C. to allow accumulation of 4HB-CoA, and then initiated by addition of purified Msed_1321. For the oxygen-sensitivity assay, Msed_1321 was washed with 100 mM potassium phosphate, pH 7.5, to remove any DTT from the reaction buffer. An aliquot of Msed_1321 was exposed to air, vortexed well, and tested with the coupled assay at the specified time intervals. During the intervening time, the enzyme and reaction buffer was stored at 4° C. The reaction buffer was made without ATP, CoA, or $NAD^+$—these were kept at −20° C. and added to the reaction at time of use.

Analysis of in vitro acetyl-CoA production. Enzymatic production of acetyl-CoA from 4HB was performed in vitro at 70° C. Acetyl-CoA synthase (ACS) from *Pyrococcus furiosus* (Glasemacher et al., 1997. Eur. J. Biochem. 244: 561-567) (Pf-ACS) was used to form acetate from acetyl-CoA, and the resultant mixture was derivatized to form the phenacyl ester using dibromoacetophenone (adapted from (Durst et al., 1975. Anal. Chem. 47:1797-1801)) and assayed using reversed-phase HPLC (Waters). The Adams' Lab at University of Georgia generously provided a recombinant *E. coli* strain containing Pf-ACS. Heat-treated, cell-free extract from this strain was used in the following assay.

The reaction mixture (100 μl) consisted of 100 mM sodium phosphate, pH 7.9, 5 mM $MgCl_2$, 3 mM ATP, 3 mM CoA, 3 mM $NAD^+$, 3 mM 4HB, 1 mM DTT, 3 mM ADP, purified recombinant Msed_0406 (500 ng/μl), Msed_1321 (50 ng/μl), Msed_0399 (50 ng/μl), and Msed_0656 (50 ng/μl). The reaction mixture was incubated at 70° C. for 20 minutes, after which 10 μl of Pf-ACS extract was added before incubating an additional 10 minutes at 95° C. The sample was cooled for room temperature, acidified with 50% $H_2SO_4$ to pH 2, and ether extracted twice with 750 ml diethyl ether. The ether fraction was neutralized with 50 μl 20 mM bicarbonate and dried down in a vacuum centrifuge for 2 hours at 30° C. The sample was resuspended in 50 μl acetonitrile with 0.5 μl of 0.5% phenolphtalein. A solution of 100 mM KOH was added until the sample turned pink (pH ~9-10), after which 100 μl of acetonitrile, 50 μl of 1 μM 15-crown-5-ether, and 200 μl of 20 mM 2,4-dibromoacetophenone were added. The solution was heated to 80° C. for 30 minutes, cooled back to room temperature, and injected (5 μl) onto a C18 silica-based column (Shodex C18-4E, 4.6×250 mm) at 30° C. The initial mobile phase composition was 60% Buffer A (0.05% trifluoroacetic acid) and 40% Buffer B (acetonitrile). Samples were eluted with a ten minute linear gradient to a final composition of 20% Buffer A and 80% Buffer B.

Results and Discussion

Conversion of 4-hydroxybutyrate to acetyl-CoA in the 3HP/4HB cycle. The final four steps in the acetyl-CoA branch of the 3HP/4HB pathway (which converts 4HB to acetyl-CoA) are putatively catalyzed by 4HB:CoA ligase (Msed_0406), 4-hydroxybutyryl-CoA dehydratase (Msed_1321), crotonyl-CoA hydratase/(S)-3-hydroxybutyryl-CoA dehydrogenase (Msed_0399), and acetoacetyl-CoA β-ketothiolase (Msed_0656) (FIG. 42). In order to confirm that these enzymes converted 4HB to acetyl-CoA, and to consider possible rate-limiting steps, recombinant versions were produced, purified to homogeneity, and characterized biochemically (FIG. 42, Table 15). For three of the enzymes, recombinant versions were readily produced. However, initial attempts to produce recombinant 4-hydroxybutyryl-CoA dehydratase (Msed_1321) were unsuccessful, possibly because this enzyme is oxygen-sensitive, based on the oxygen sensitivity of a well-studied homolog from an anaerobic bacterium, *Clostridium aminobutyricum* (Scherf et al., 1993. Eur. J. Biochem. 215:421-429; Müh et al., 1996. Biochemistry 35:11710-11718; Martins et al., 2004. Proc. Natl. Acad. Sci. U.S.A. 101:15645-15649). As such, both expression and purification of Msed_1321 were conducted under anaerobic conditions: an expression system based on the hya promoter from *E. coli* (Sun et al., 2010. PLoS One 5:e10526) was used, and recombinant cell lysis and protein purification were carried out in an anaerobic chamber (95% $N_2$, 5% $H_2$). This approach resulted in production of soluble, active enzyme. However, subsequent testing of Msed_1321 revealed it to be much less oxygen sensitive than its clostridial counterpoint. With a half-life of roughly 4 days, Msed_1321 proved to be surprisingly robust in the presence of oxygen. This increased oxygen tolerance relative to the *C. aminobutyricum* enzyme could be an adaptive trait associated with the aerobic environments inhabited by *M. sedula*.

TABLE 15

Kinetic Properties of selected *M. sedula* enzymes from the acetyl-CoA branch of the 3HP/4HB pathway

| Enzyme | ORF | $V_{max}$ (μmol min$^{-1}$ mg$^{-1}$) | $K_m$ (mM) | $k_{cat}$ (s$^{-1}$) | $k_{cat}/K_m$ (s$^{-1}$ M$^{-1}$) |
|---|---|---|---|---|---|
| 4-Hydroxybutyrate: CoA synthetase | Msed_0406 | 1.7 | 2.0 | 1.8 | 910 |
| 4-Hydroxybutyryl-CoA dehydratase | Msed_1321 | 2.2 | 0.15 | 2.1 | $1.4 \times 10^4$ |
| Crotonyl-CoA hydratase | Msed_0399 (C-CoA) | 20 | 0.07 | 19 | $2.6 \times 10^5$ |
| (S)-3-Hydroxybutyryl-CoA dehydrogenase | Msed_0399 (3HB-CoA) | 16 | 0.06 | 15 | $2.6 \times 10^5$ |
| Acetoacetyl-CoA β-ketothiolase | Msed_0656 | 1400 | 0.18 | 1000 | $5.6 \times 10^6$ |

In a previous study, two separate genes (Msed_0406 and Msed_0394) were found to encode acyl-CoA synthetases with activity on 4HB (8). Both Msed_0406 and Msed_0394 showed activity on a broad range of linear, unsubstituted organic acids (C2-C5). Although Msed_0406 catalyzed CoA ligation at a faster rate than Msed_0394 for the range of substrate concentrations examined ($V_{max}$–1.7 and 0.22 μmol min$^{-1}$ mg$^{-1}$, respectively), it is possible that both enzymes contributed to this in vivo activity in *M. sedula*. The reaction rate for 4-hydroxybutyryl-CoA dehydratase (Msed_1321), the subsequent enzyme in the cycle, is comparable to Msed_0406. Thus, these two steps could be rate-limiting bottlenecks for the acetyl-CoA branch of the 3HP/4HB pathway, since their activities are approximately 10-fold lower than that for the two steps catalyzed by Msed_0399 (20 and 16 μmol min$^{-1}$ mg$^{-1}$ for the hydration and dehydrogenase reactions, respectively), and Msed_0656 (1400 μmol min$^{-1}$ mg$^{-1}$). The high $K_m$ value for Msed_0406 (2.0 mM) stands out as being much higher than the $K_m$ values for the rest of the enzymes (Msed_1321-0.15 mM, Msed_0399-0.07 mM, Msed_0656-0.18 mM), and suggests that post-transcriptional mechanisms impact substrate entry into the Acetyl-CoA branch.

Figure 43:
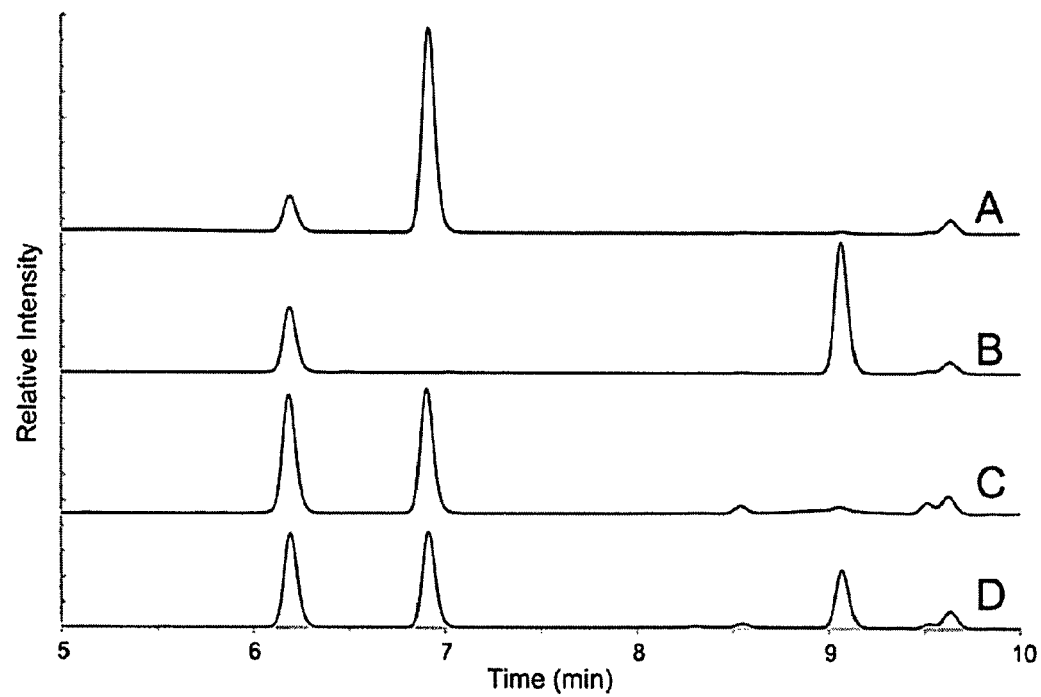
FIG. 43. HPLC chromatograms demonstrating in vitro production of acetate from 4-hydroxybutyrate. Samples and standards were derivatized using dibromoacetophenone (DBAP) and run on a reversed-phase column to show production of acetate. Chromatograms shown are: A) 4HB standard, B) 3HP standard, C) control reaction containing buffer, cofactors, and 4HB but no enzymes, and D) SP3 reaction using recombinant enzymes. Retention times: 6.9 min for 4HB and 9.1 min for acetate.

HPLC was used to confirm production of acetyl-CoA from 4HB using all four enzymes. To detect organic acids using HPLC, samples were derivatized with 2,4-dibromoacetophenone (DBAP) and then run on a reversed-phase C18 column. The reaction mixture containing 4HB and all the necessary cofactors and enzymes was first incubated at 70° C., followed by addition of Pf-ACS and a second incubation at 95° C. to convert all the acetyl-CoA to acetate. The HPLC chromatograms for the reaction mixture, control, and standards (FIG. 43) confirm the in vitro conversion of 4HB to acetate using recombinant versions of these enzymes.

Refined autotrophic growth conditions for *M. sedula* transcriptomic analysis. For initial efforts focusing on *M. sedula* under autotrophic conditions, cultures were grown in sealed bottles in a shaking orbital bath starting with a known headspace gas composition (Auernik and Kelly, 2010, Appl. Environ. Microbiol. 76:931-935). Mass transfer of $H_2$, $CO_2$, and $O_2$ into the liquid medium was neither controlled nor enhanced and, thus, growth was subject to significant diffusional limitations. To address this issue here, gas-intensive aerobic growth of *M. sedula* was optimized by controlling gas feed to a 3 L bioreactor. Gas feed rates were controlled using rotameters and a micro-bubble sparging stone (2-μm pore size) was used to increase dissolution of sparingly soluble gases, $H_2$ in particular. The doubling time for *M. sedula* exponential growth for $H_2$—$CO_2$ autotrophy decreased from 11-13 h in sealed bottles to 5-6 hours in the gas-intensive bioreactor, indicative of significant gas-liquid mass transfer limitations in the static cultures. These improved doubling times for autotrophic growth were comparable to heterotrophic growth on 0.1% tryptone (5-6 hours), suggesting that metabolic limitations from gas supply were alleviated to a significant extent.

Possible limitations of $CO_2$ gas-liquid mass transfer were investigated for three growth conditions: autotrophic carbon-rich (ACR) (80% $H_2$ and 20% $CO_2$), autotrophic carbon-limited (ACL) (80% $H_2$ and 20% $N_2$), and heterotrophic (HTR) (80% $N_2$ and 20% $CO_2$) with 0.1% tryptone supplemented to the medium. In the ACL condition, all available inorganic carbon came from atmospheric $CO_2$ in the air feed. The observed growth rate for HTR and ACR cultures was comparable ($t_d$=6.7 h and 6.8 h, respectively), and faster than for the ACL culture ($t_d$=9.4 h).

Of the 2293 protein-coding genes in the *M. sedula* genome, 984 responded 2-fold or more when comparing HTR with the ACL condition. While trends were consistent with previous results from less defined growth conditions (Auernik and Kelly, 2010, Appl. Environ. Microbiol. 76:931-935), in many cases, they were more pronounced. Among the most highly up-regulated genes for the HTR vs. ACL contrast were those directly involved in $CO_2$ fixation in the 3HP/4HB pathway, especially acetyl-CoA/propionyl-CoA carboxylase (Msed_0147, Msed_0148, Msed_1375-7- to 30-fold), 4-hydroxybutyryl-CoA dehydratase (Msed_1321-27-fold), and carbonic anhydrase (Msed_0390-29-fold). The effects of carbon dioxide limitation was especially evident for the β-class carbonic anhydrase encoded in Msed_0390; transcript levels were induced 3.7-fold for the carbon-rich (ACR) vs. heterotrophy (HTR) contrast, compared to nearly 30-fold higher for the carbon-limited condition (ACL). This indicates that increasing the rate of bicarbonate formation from $CO_2$ is essential for rapid growth.

Bicarbonate formation actually depends on two separate reversible equilibria—first, the hydration of aqueous $CO_2$ to form carbonic acid ($H_2CO_3$) and second, the first ionization of polyprotic carbonic acid to form bicarbonate ($HCO_3$). In aqueous solution at 70° C., the reaction rate of the hydration step will be roughly 75-fold faster than at 25° C. (Wang et al., 2009. The Journal of Physical Chemistry A 114:1734-1740). The equilibrium constant only increases by 2-fold (2.4 e-05 M$^{-1}$ at 25° C. vs 4.0e-05 M$^{-1}$ at 70° C.), so even at elevated temperatures the concentration of aqueous CO2 is roughly 25,000 times greater than the concentration of carbonic acid (Wang et al., 2009. The Journal of Physical Chemistry A 114:1734-1740). However the apparent pKa of the ionization of carbonic acid to bicarbonate at 65C is about 6.3, which means that at low pH virtually no bicarbonate exists in solution. *M. sedula* therefore likely uses carbonic anhydrase to convert $CO_2$ to carbonic acid in the cytoplasm, where the pH value is closer to neutral. The intracellular pH of *Sulfolobus acidocaldarius*, an acidophilic archaeon very closely related to *M. sedula*, has been measured to be around 6.5 (Baker-Austin et al., 2007. Trends Microbiol. 15:165-171). At that pH, the rapid ionization of carbonic acid to bicarbonate would provide the necessary substrate for carbon fixation and cellular growth.

The transcriptional response data from growth under gas-intensive conditions provided a clearer picture of the role of genes associated with *M. sedula* hydrogenases in $H_2$—$CO_2$ autotrophy. Genes encoded in Msed_0913-0950 were all up-regulated. This locus encodes the two Ni—Fe hydrogenases (Msed_0923-0924, Msed_0944-0945), multiple accessory proteins (HypABCDF), a maturation protease (Msed_0916), and additional hypothetical proteins that were all highly up-regulated under autotrophy. The only potential hydrogenase-related protein not associated with this locus is Msed_2256, which has 48% amino acid identity over the entire open reading frame to SlyD from *Pyrococcus furiosus*, a chaperone protein that participates in the recruitment of HypB, a nickel-binding GTPase (Chung et al., 2010. FEBS Lett. 585:291-294). Msed_2256 was not up-regulated under $H_2$—$CO_2$ autotrophy, but is constitutively transcribed at high levels under all growth conditions. Transcripts for both Ni—Fe hydrogenases were up-regulated 5 to 10-fold under autotrophy, although their absolute transcript levels differed significantly; Msed_0944-0945 was transcribed at ~30-fold higher levels than Msed_0923-0924 for both heterotrophy and autotrophy. Msed_0943-0950, which encodes a membrane-associated hydrogenase, was strongly up-regulated under autotrophic conditions (Msed_0949-48-fold increase; Msed_0948-42-fold increase; Msed_0947-19-fold increase). This Ni—Fe hydrogenase is likely the primary enzyme responsible for energy conservation via molecular hydrogen oxidation.

Figure 44:
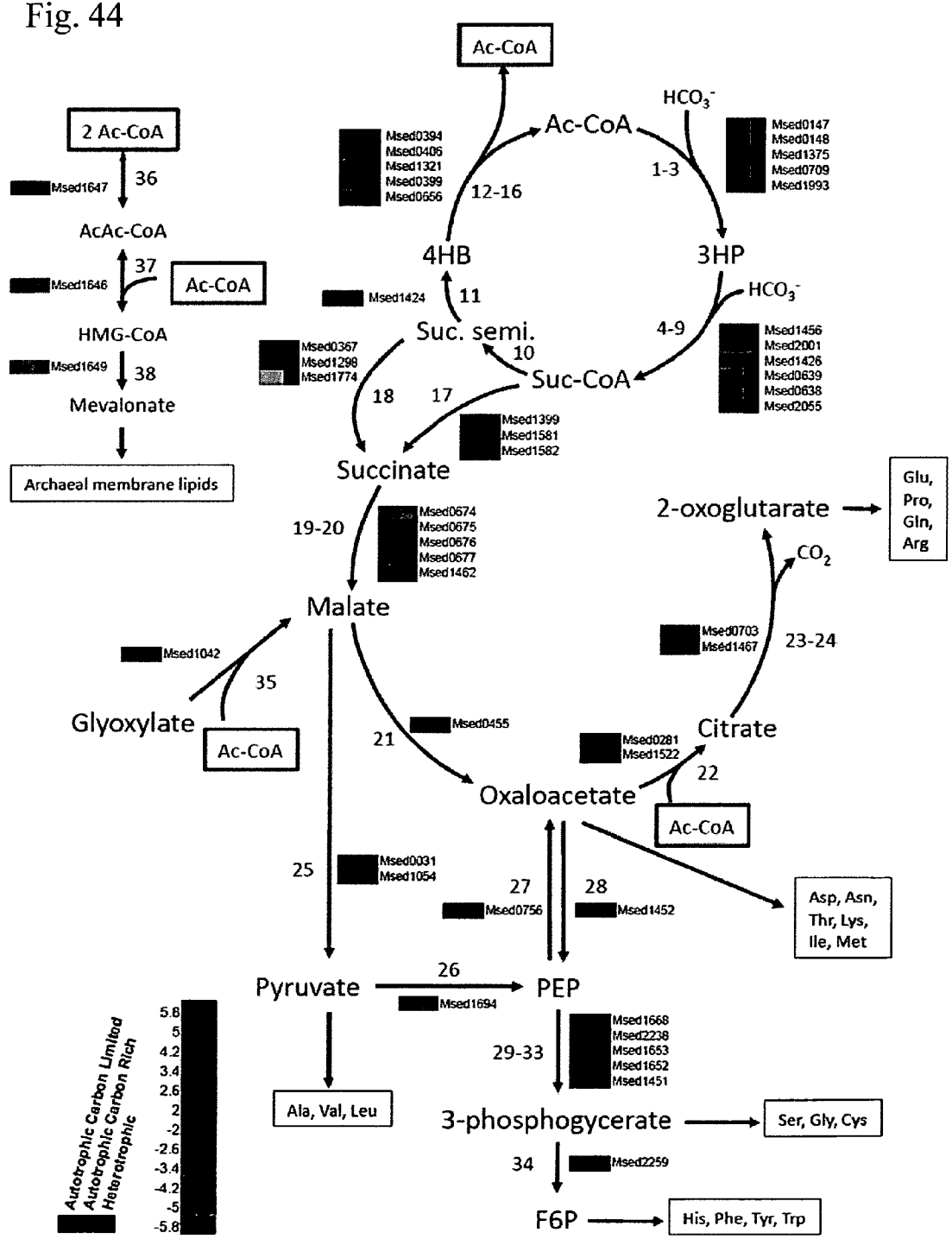
FIG. 44. Transcriptional Heatmap for proposed 3HP/4HB cycle and central metabolism in *M. sedula*. Metabolic diagram shows 3HP/4HB pathway (top center), incomplete tricarboxylic acid cycle (TCA, center), gluconeogenesis (bottom center), and isoprenoid-based lipid biosynthesis pathways (top left). Metabolic network adapted from Estelmann et. al. Enzymes: 1, acetyl-CoA/propionyl-CoA carboxylase; 2, malonyl-CoA reductase (NADPH); 3, malonic semialdehyde reductase (NADPH); 4, 3HP-CoA synthetase (AMP-forming); 5, 3-hydroxypropionyl-CoA dehydratase; 6, acryloyl-CoA reductase (NADPH); 7, acetyl-CoA/propionyl-CoA carboxylase; 8, methylmalonyl-CoA epimerase; 9, methylmalonyl-CoA mutase; 10, succinyl-CoA reductase (NADPH); 11, succinic semialdehyde reductase (NADPH); 12, 4HB-CoA synthetase (AMP-forming); 13, 4-hydroxybutyryl-CoA dehydratase; 14 and 15, crotonyl-CoA hydratase/(S)-3-hydroxybutyryl-CoA dehydrogenase ($NAD^+$); 16, acetoacetyl-CoA b-ketothiolase; 17, succinyl-CoA synthetase (ADP-forming); 18, succinic semialdehyde dehydrogenase; 19, succinate dehydrogenase; 20, fumarate hydratase; 21, malate dehydrogenase; 22, (si)-citrate synthase; 23, aconitase; 24, isocitrate dehydrogenase; 25, malic enzyme; 26, pyruvate:water dikinase (ATP); 27, PEP carboxylase; 28, PEP carboxykinase (GTP); 29, enolase; 30, phosphoglycerate mutase; 31, phosphoglycerate kinase; 32, glyceraldehyde-3-phosphate dehydrogenase; 33, triosephosphate isomerase; 34, fructose 1,6-bisphosphate aldolase/phosphatase; 35, malate synthase; 36, acetyl-CoA acetyltransferase; 37, HMG-CoA synthase; 38, HMG-CoA reductase. Abbreviations: Ac-CoA—acetyl-CoA, 3HP—3-hydroxypropionate; Suc-CoA—succinyl-CoA; Suc. semi.—succinic semialdehyde; 4HB—4-hydroxybutyrate; AcAc-CoA—Acetoacetyl-CoA; HMG-CoA—3-hydroxy-3-methyl-glutaryl-CoA; PEP—phosphoenolpyruvate; F6P—Fructose-6-phosphate.

Assimilation and anapleurosis of acetyl-CoA during $H_2$—$CO_2$ autotrophy. Taken together, the transcriptomics data acquired through the gas-intensive bioreactor provided a more complete perspective on the assimilation and anapleurosis of acetyl-CoA during growth of *M. sedula* by $H_2$—$CO_2$ autotrophy. FIG. 44 summarizes these data for genes implicated in $CO_2$ fixation and central metabolism (adapted from (Estelmann et al., 2011. J. Bacteriol. 193:1191-1200)). Acetyl-CoA is shown in red boxes to highlight where it is produced or required. The schematic includes the initial steps of the isoprenoid-based lipid biosynthesis pathway (mevalonate pathway) and amino acid biosynthesis groups (shown in black boxes). Note that both PEP carboxylase and PEP carboxykinase are included in FIG. 44 (Enzymes 27 and 28). Assays of *M. sedula* extract detected activity for PEP carboxykinase (70 nmol min$^{-1}$ mg$^{-1}$ in autotrophic extracts), but no activity for PEP carboxylase in either autotrophic or heterotrophic extracts was found (Estelmann et al., 2011. J. Bacteriol. 193:1191-1200).

The transcription of most genes directly involved in the 3HP/4HB $CO_2$ fixation cycle (see upper right in FIG. 44) were triggered under limiting $CO_2$ concentrations. However, the genes encoding the incomplete tricarboxylic acid cycle (TCA) are not as responsive, suggesting other mechanisms of regulation. These data support previous carbon flux analysis for the 3HP/4HB pathway that showed that carbon from $CO_2$ enters central metabolism via succinate (Estelmann et al., 2011. J. Bacteriol. 193:1191-1200). Genes encoding succinate dehydrogenase (Msed_0674-0677) were constitutively transcribed at high levels (75% percentile of the transcriptome), along with a gene annotated as fumarate hydratase (Msed_1462) (70% percentile). No strong transcriptional response was observed for potential candidates for succinic semialdehyde dehydrogenase (Msed_0367, Msed_1298, or Msedl 774) or succinyl-CoA synthetase (Msed_1581-1582); transcripts for Msed_1581-1582, were actually down-regulated under autotrophy (6-fold and 5-fold, respectively). This is consistent with the low activity measured for succinyl-CoA synthase in extracts from heterotrophically grown cells (146 nmol min$^{-1}$ mg$^{-1}$), which was actually higher than the activity in extracts from autotrophically grown cells (36 nmol min$^{-1}$ mg$^{-1}$). Transcript levels for possible succinic semialdehyde dehydrogenase candidates varied: Msed_1774 decreased under autotrophy (down 3.6-fold), while Msed_0367 and Msed_1298 showed no differential response and average transcript levels relative to the transcriptome. Whether these ORFs have been correctly annotated or whether other unidentified genes are responsible for these biotransformations remains to be seen.

Metabolic flux analysis of *M. sedula* metabolism using labeled 4-hydroxy[1-$^{14}$C]butyrate and [1,4-$^{13}$C$_1$]succinate showed an unexpected route linking the carbon fixation cycle to central metabolism (Estelmann et al., 2011. J. Bacteriol. 193:1191-1200). Initially, it was suggested that acetyl-CoA was reductively carboxylated directly to pyruvate by pyruvate synthase (Berg et al., 2007. Science 318:1782-1786). However, the labeling patterns of the amino acids did not support this hypothesis, and instead it was argued that the major flux from the carbon fixation pathway happens via succinyl-CoA. Oxidation of succinyl-CoA to malate and oxaloacetate yield pyruvate and phosphoenolpyruvate (PEP), respectively. Therefore, to make one molecule of pyruvate with the 3HP/4HB pathway, it requires 1.5 turns of the cycle—one full turn to make acetyl-CoA and another half-turn to make succinyl-CoA. In the anaerobic DC/4HB pathway, pyruvate can be formed directly from acetyl-CoA by reductive carboxylation. This makes the aerobic 3HP/4HB pathway nearly twice as expensive energetically, requiring nine ATP equivalents to make one molecule of pyruvate compared to five for the DC/4HB pathway (Berg et al., 2010. Nat. Rev. Microbiol. 8:447-460; Estelmann et al., 2011. J. Bacteriol. 193:1191-1200).

Although the genes encoding for succinic semialdehyde dehydrogenase or succinyl-CoA synthetase were not transcriptionally responsive, the data do not preclude their involvement. In the case of succinic semialdehyde dehydrogenase, it may be that there are as yet unidentified genes responsible for the conversion. Clearly the activity levels are sufficient for the transformations, and the labeling data unambiguously supports the primacy of the succinate branch for carbon flux into central metabolism.

Beyond succinyl-CoA, it appears that acetyl-CoA assimilation still has an important role as a biosynthetic precursor based on the total cell carbon measured in the labeling studies (Estelmann et al., 2011. J. Bacteriol. 193:1191-1200). This does not occur through reductive carboxylation of acetyl-CoA to pyruvate, but instead through incorporation into other central carbon intermediates, such as citrate and malate (FIG. 44). Acetyl-CoA is also essential for isoprenoid-based lipid biosynthesis in Archaea (Koga and Morii, 2007. Microbiol. Mol. Biol. Rev. 71:97-120; Boucher et al., 2004. Molecular Microbiology 52:515-527), and indeed, 33% of the 4-hydroxy[1-$^{14}$C]butryate label fed to autotrophically growing *M. sedula* ended up in the lipid and pigment fraction (Estelmann et al., 2011. J. Bacteriol. 193:1191-1200). The initial steps of isoprenoid biosynthesis require the condensation of two molecules of acetyl-CoA to acetoacetyl-CoA (FIG. 42). When growing autotrophically, acetoacetyl-CoA could be recruited directly from the 3HP/4HB pathway, or alternatively formed by acetyl-CoA acetyltransferase (Msed_1647). 3-hydroxy-3-methyl-glutaryl-CoA (HMG-CoA) is formed by HMG-CoA synthase (Msed_1646) and reduced to mevalonic acid (Matsumi et al., 2011. Res. Microbiol. 162:39-52). Interestingly, both Msed_1646 and Msed_1647 are expressed 5-fold higher under HTR compared to ACL. However, HMG-CoA is also produced during the catabolism of leucine, which may account for the increased expression levels of these two genes. The remaining enzyme in the synthesis of mevalonate (Msed_1649) did not show any differential transcription between the tested growth conditions.

The assimilation of acetyl-CoA directly into central carbon intermediates occurs both through citrate and malate synthesis. There are two genes in *M. sedula* annotated as citrate synthase, Msed_0281 and Msed_1522, which under autotrophy were down-regulated 7-fold and up-regulated 3.8-fold, respectively. The role of malate synthase in *M. sedula* metabolism is still uncertain. There is a gene in the *M. sedula* genome annotated as malate synthase, Msed_1042, that is constitutively expressed at high levels (80% percentile) and malate synthase activity has been measured in autotrophic cell extracts (58 nmol $min^{-1}$ $mg^{-1}$) (Estelmann et al., 2011. J. Bacteriol. 193:1191-1200). However, *M. sedula* does not have a gene for isocitrate lyase and activity was found neither in autotrophic nor heterotrophic extracts, which suggests that glyoxylate is not being formed from isocitrate to prevent loss of $CO_2$. Thus it is unclear what role malate synthase has in *M. sedula*, or how the glyoxylate is being formed. The recent report of malate synthase participation in pentose metabolism in Sulfolobales does not appear to be related, as *M. sedula* does not grow on sugars (Nunn et al., 2010. J. Biol. Chem. 285:33701-33709).

Regulation of flux between the succinate and acetyl-CoA branches. Succinyl-CoA, therefore, represents a branching point where carbon flux either proceeds towards malate or continues through the cycle to 4HB and acetyl-CoA. The enzymes utilized in the acetyl-CoA branch were expressed, biochemically characterized, and the sub-pathway reconstructed in vitro. Based on enzyme kinetic data, flux through the acetyl-CoA branch appears dependent on the activity of 4-HB-CoA synthetase. Previous work has established that activity of acetyl-CoA synthetase is controlled by acetylation of a conserved lysine residue by Sir2 (Starai et al., 2002. Science 298:2390-2392). Regulation on 4HB-CoA synthetase makes sense from an energetic standpoint, since this reaction requires an investment of 2 ATP equivalents to activate 4HB and form the thioester bond. Thermodynamically, this investment is not essential for the transformation of 4HB to acetate, but the formation of the high-energy thioester bond serves to help overcome other, less thermodynamically favorable reactions elsewhere in the carbon fixation pathway, such as carboxylation and carbonyl reduction reactions (Bar-Even et al., 2012. Biochim. Biophys. Acta 1817:1646-1659). The high Michaelis-Menten constant for Msed_0406 (2 mM) indicates that intracellular levels of 4HB must be high to overcome the activity barrier. The reaction rate for the subsequent transformation, the dehydration by 4HBD, is also slow (2.2 µmol $min^{-1}$ $mg^{-1}$) and, hence, these two reactions form the rate-limiting steps for the acetyl-CoA branch. The final three reactions, catalyzed by the bifunctional crotonyl-CoA hydratase/(S)-3-hydroxybutyrate dehydrogenase and acetoacetyl-CoA β-ketothiolase, have much faster reaction rates, 20/16 µmol $min^{-1}$ $mg^{-1}$ and 1400 µmol $min^{-1}$ $mg^{-1}$, respectively. Taken together, these indicate that 4HB-CoA synthetase activity serves as the entry point both kinetically and energetically to the acetyl-CoA branch, and as such is the primary determinant of carbon flux distribution.

Oxygen tolerance of 4-hydroxybutyryl-CoA dehydratase from *M. sedula*. Here, we also report the cloning and characterization of 4-hydroxybutyryl-CoA dehydratase (4hbd—Msed_1321), the first recombinant homolog of this unique enzyme cloned from an archaeal host. First discovered in *Clostridium aminobutryicum* (Gerhardt et al., 2000. Arch. Microbiol. 174:189-199), this enzyme has drawn a lot of interest due to its unusual radical-based catalysis mechanism (Martins et al., 2004. Proc. Natl. Acad. Sci. U.S.A. 101:15645-15649; Buckel et al., 2006. Annu. Rev. Microbiol. 60:27-49). The clostridial version is active as a homotetramer with one $[4Fe-4S]^{2+}$ cluster and one flavin adenine dinucleotide (FAD) cofactor per subunit (Martins et al., 2004. Proc. Natl. Acad. Sci. U.S.A. 101:15645-15649). The *M. sedula* homolog was also found to associate as a homotetramer (222 kDa, subunit mass=56.6 kDa). When exposed to air, the clostridal homolog was slightly activated due to oxidation of the FAD cofactor, followed by oxidation of the Fe—S cluster leading to irreversible inactivation in ~25 min (Scherf et al., 1993. Eur. J. Biochem. 215:421-429). However, the *M. sedula* homolog was much more robust to oxygen exposure. The same initial activation upon exposure to air was observed but lasted for about 15 hours instead of mere minutes; enzyme activity continued to drop slowly over the course of the next week, with an observed half-life of 4 days. This substantial increase in oxygen tolerance is probably an adaptive trait acquired as a result of the aerobic environment in *M. sedula*.

Transcriptional patterns of 2-oxoacid oxidoreductases in *M. sedula*. There are several operons in the *M. sedula* genome containing genes annotated as putative 2-oxoacid oxidoreductases, however the exact nature of their role in metabolism remains uncertain. Previous assays have found very low levels of 2-oxoglutarate and pyruvate oxidoreductase activity in both heterotrophic and autotrophic cell extract (2-3 µmol $min^{-1}$ $mg^{-1}$) (Estelmann et al., 2011. J. Bacteriol. 193:1191-1200). FIG. 45 shows the transcriptional profile of putative 2-oxoacid oxidoreductases under heterotrophy and autotrophy. Most of these loci either showed no transcriptional change (Msed_0507-0510, Msed_1199-1201) or were down-regulated under autotrophy (Msed_0306-0309, Msed_0524-0525, Msed_1596-1597), however the most striking change was the down-regulation of Msed_1596 and Msed_1597, whose transcription levels decreased 23- and 10-fold, respectively. This strong transcriptional response clearly implicates Msed_1596-1597 in some crucial, but as yet unknown, role under heterotrophic growth.

Conclusion. Here, the recombinant expression and characterization of two enzymes in the final steps of the 3HP/4HB pathway are reported and in vitro production of acetate from 4HB is confirmed. The level of biochemical detail of the 3HP/4HB pathway in relationship to central metabolism continues to develop, which will inform future metabolic engineering prospects for microbial biosynthesis of fuels and organic chemicals (Hawkins et al., 2013. Curr. Opin. Biotechnol. 24:376-384).

The complete disclosure of all patents, patent applications, and publications, and electronically available material (including, for instance, nucleotide sequence submissions in, e.g., GenBank and RefSeq, and amino acid sequence submissions in, e.g., SwissProt, PIR, PRF, PDB, and translations from annotated coding regions in GenBank and RefSeq) cited herein are incorporated by reference in their entirety. Supplementary materials referenced in publications (such as supplementary tables, supplementary figures, supplementary materials and methods, and/or supplementary experimental data) are likewise incorporated by reference in their entirety. In the event that any inconsistency exists between the disclosure of the present application and the disclosure(s) of any document incorporated herein by reference, the disclosure of the present application shall govern. The foregoing detailed description and examples have been given for clarity of understanding only. No unnecessary limitations are to be understood therefrom. The invention is not limited to the exact details shown and described, for variations obvious to one skilled in the art will be included within the invention defined by the claims.

Unless otherwise indicated, all numbers expressing quantities of components, molecular weights, and so forth used in the specification and claims are to be understood as being modified in all instances by the term "about." Accordingly, unless otherwise indicated to the contrary, the numerical parameters set forth in the specification and claims are approximations that may vary depending upon the desired properties sought to be obtained by the present invention. At the very least, and not as an attempt to limit the doctrine of equivalents to the scope of the claims, each numerical parameter should at least be construed in light of the number of reported significant digits and by applying ordinary rounding techniques.

Notwithstanding that the numerical ranges and parameters setting forth the broad scope of the invention are approximations, the numerical values set forth in the specific examples are reported as precisely as possible. All numerical values, however, inherently contain a range necessarily resulting from the standard deviation found in their respective testing measurements.

All headings are for the convenience of the reader and should not be used to limit the meaning of the text that follows the heading, unless so specified.

SEQUENCE LISTING (403 sequences)

SEQ ID NO: 1 - protein, 510 aa, Metallosphaera sedula
MPPFSRVLVANRGEIAVRVMKAIKEMGMTAIAVYSEADKYAVHVKYADEAYYIGPSPALESYLNIPHIIDAAEKAHADAVHPGYGFLSENADFVEAVEKAGMTYIGPSAEVMRKIKDKLDGKRIAQLSGVPIAPGSDGPVESIDEALKLAEKIGYPIMVKAASGGGGVGITKIDTPDQLIDAWERNKRLATQAFGRSDLYIEKAAVNPRHIEFQLIGDKYGNYVVAWERECTIQRRNQKLIEEAPSPAITMEERSRMFEPIYKYGKLINYFTLGTFETVFSDATREFYFLELNKRLQVEHPVTELIFRIDLVKLQIRLAAGEHLPFTQEELNKRARGAAIEFRINAEDPINNFSGSSGFITYYREPTGPGVRMDSGVTEGSWVPPFYDSLVSKLIVYGEDRQYAIQTAMRALDDYKIGGVKTTIPLYKLIMRDPDFQEGRFSTAYISQKIDSMVKKLKAEEEMMASVAAVLQSRGLLRKKASAPQEQAKPGSGWKSYGIMMQSTPRVMWG

SEQ ID NO: 2 - protein, 167 aa, Metallosphaera sedula
MKLYRVHADTGDTFIVAHDQKENKDRLKTENNEFEIEYVGQGTREGEIILKINGEMHRVFIDNGWIILDNARIFRAERVTELPTQEGQTLDEMIKGKEGEVLSPLQGRVVQVRVKEGDAVNKGQPLLSIEAMKSETIVSAPISGLVEKVLVKAGQGVKKGDILVVIK

SEQ ID NO: 3 - protein, 524 aa, Metallosphaera sedula
MTATFEKPDMSKLVEELRALKAKAYMGGGEERVQAQHAKGKLTARERLNLLFDEGTFNEVMTFATTKATEFGLDKSKVYGDGVVTGWGQVEGRTVFAFAQDFTSIGGTLGETHASKIAKVYELALKVGAPVVGINDSGGARIQEGAVALEGYGTVFKANVMASGVVPQITIMAGPAAGGAVYSPALTDFIIMIKGDAYYMFVTGPEITKVVLGEDVSFQDLGGAVIHATKSGVVHFIAENEQDSINITKRLLSYLPSNNMEEPPFMDTGDPADREMKDVESVVPTDTVKPFDMREVIYRTVDNGEFMEVQKHWAQNMVVGFGRVAGNVVGIVANNSAHLGAAIDIDASDKAARFIRFCDAFNIPLISLVDTPGYMPGTDQEYKGIIRHGAKMLYAFAEATVPKVTVVVRRSYGGAHIAMSIKSLGADLIYAWPSAEIAVTGPEGAVRILYRREIQNSKSPDDLIKERIAEYKKLFANPYWAAEKGLIDDVIEPKDTRKVIASALKMLKNKREFRYPKKHGNIPL

SEQ ID NO: 4 - protein, 357 aa, Metallosphaera sedula
MRRTLKAAILGATGLVGIEYVRMLADHPYIKPTYLAGKGSVGKPYGEIVRWQTVGNVPKEVANQEVKPTDPKLMDDVDIIFSPLPQGAAGPVEEQFAKLGFNVISNSPDHRFDMDVPMIIPEVNPHTVTLIDEQRKRRDWKGFIVTTPLCTAQGAAIPLTPIYQNFKMSGVMITTMQSLSGAGYPGIASLDIVDNALPLGDGYDAKTVKEITRILSEVKRNVQEPGVNEITLDATTHRIATIHGHYEVAYVTFKEDTDVRKVMESMESFKGEPQDLKLPTAPEKPIIVTTQDARPQVFFDRWAGNPPGMSVVVGRLKQVNPRTIRFVSLIHNTVRGAAGGGVLTAELLVEKGYIDKR

SEQ ID NO: 5 - protein, 314 aa, Metallosphaera sedula
MTEKVSVVGAGVIGVGWATLFASKGYSVSLYTEKKETLDKGIEKLRNYVQVMKNNSQITEDVNTVISRVSPTTNLDEAVRGANFVIEAVIEDYDAKKKIFGYLDSVLDKEVILASSTSGLLITEVQKAMSKHPERAVIAHPWNPPHLLPLVEIVPGEKTSMEVVERTKSLMEKLDRIVVVLKKEIPGFIGNRLAFALFREAVYLVDEGVATVEDIDKVMTAAIGLRWAFMGPFLTYHLGGGEGGLEYFFNRGFGYGANEWMHTLAKYDKFPYTGVTKAIQQMKEYSFIKGKTFQEISKWRDEKLLKVYKLVWEK

SEQ ID NO: 6 - protein, 661 aa, Metallosphaera sedula
MFMRYIMVEEQTLKTGSQELEEKADYNMRYYAHLMKLSKEKPAEFWGSLAQDLLDWYEPWKETMRQEDPMTRWFIGGKINASYNAVDRHLNGPRKFKAAVIWESELGERKIVTYQDMFYEVNRWANALRSLGVGKGDRVTIYMPLTPEGIAAMLASARIGAIHSVIFAGFGSQAIADRVEDAKAKVVITADAYPRRGKVVELKKTVDEALNSLGERSPVQHVLVYRRMKTDVNMKEGRDVFFDEVGKYRYVEPERMDSNDPLFILYTSGTTGKPKGIMHSTGGYLTGTAVMLLWSYGLSQENDVLFNTSDIGWIVGHSYITYSPLIMGRTVVIYESAPDYPYPDKWAEIIERYRATTFGTSATALRYFMKYGDEYVKNHDLSSIRIIVTNGEVLNYSPWKWGLEVLGGGKVFMSHQWWQTETGAPNLGYLPGIIYMPMKSGPASGFPLPGNFVEVLDENGNPSAPRVRGYLVMRPPFPPNMMMGMWNDNGERLKKTYFSKFGSLYYPGDFAMVDEDGYIWVLGRADETLKIAAHRIGAGEVESAITSHPSVAEAAVIGVPDSVKGEEVHAFVVLKQGYAPSSELAKDIQSHVRKVMGPIVSPQIHFVDKLPKTRSGKVMRRVIKAVMMGSSAGDLTTIEDEASMDEIKKAVEELKKELKTS

SEQ ID NO: 7 - protein, 259 aa, Metallosphaera sedula
MEFETIETKKEGNLFWITLNRPDKLNALNAKLLEELDRAVSQAESDPEIRVIIITGKGKAFCAGADITQFNQLTPAEAWKFSKKGREIMDKIEALSKPTIAMINGYALGGGLELALACDIRIAAEEAQLGLPEINLGIYPGYGGTQRLTRVIGKGRALEMMMTGDRIPGKDAEKYGLVNRVVPLANLEQETRKLAEKIAKKSPISLALIKEVVNRGLDSPLLSGLALESVGWGVVFSTEDKKEGVSAFLEKREPTFKGK

SEQ ID NO: 8 - protein, 332 aa, Metallosphaera sedula
MKAVVVKGHKQGYEVREVQDPKPASGEVIIKVRRAALCYRDLLQLQGFYPRMKYPVVLGHEVVGEILEVGEGVTGFSPGDRVISLLYAPDGTCHYCRQGEEAYCHSRLGYSEELDGFFSEMAKVKVTSLVKVPTRASDEGAVMVPCVTGMVYRGLRRANLREGETVLVTGASGGVGIHALQVAKAMGARVVGVTTSEEKASIVGKYADRVIVGSKFSEEAKKEDINVVIDTVGTPTFDESLKSLWMGGRIVQIGNVDPTQSYQLRLGYTILKDIAIIGHASATRRDAEGALKLTAEGKIRPVVAGTVHLEEIDKGYEMLKDKHKVGKVLLTT

SEQ ID NO: 9 - protein, 140 aa, Metallosphaera sedula
METLDIDHVGVAVENLEEAIKLYTEKMGMKLVHREDLPDRGIKVAFLTGNEGTTAVELMEPMNHEDPNNTVAKFLKTRGQGMHHLAVKVKDINSSLRDLEGKGLTLIDKNGRKGARGHLVAFVHPKSVMGLLLELVQETH

SEQ ID NO: 10 - protein, 553 aa, Metallosphaera sedula
MVTPERVKEWESKYLQPWISKRKERKNKFTTPSGIEIKTLYTPLDLKGDYEEKIGFPGEYPYTRGIYPNMYRGRIWTIRQYAGFGSAEDTNARFRKLLEAGQTGLSTAFDLPTQLGLDPDNELAYTEVGVVGVSMFHWKEMDIVTNQIPLNKVSTSMTINATAMELLSMYVATAESRGVSPTEIDGTVQNDILKEYIARKNYIYPPEPSMRYAIDIIEYSYKNIPKWHPISISGYHIREAGADAVLEVAFTLADGIEYVRRTAERGIPVDDFAPTLSFFFAGYTNLFEEVAKFRAARRMWAKIMRDMFNAKKADSMTLKFHTQTGGAELTAQQPEINIIRTTIQALAAALGGTQSLHVNSYDEAVALPSEKAAKIAIRVQQIVAYESGSTETVDPLAGSYYVEWLTDEIEERAWKIIERVEGMGGMMKAVERGFPQAEIAESAYRLQKKIEEGEMIRVGVNMSYEPDWIGTTEVFRVNPEIRERVLTRLKKYRSERDQMKVRDSLNALRKAAENPSVNLFPYVLDAIKKGCTVGEISSTLREIWGEYKEPIIF

SEQ ID NO: 11 - protein, 139 aa, Metallosphaera sedula
MDKRIKVVVAKLGLDGHDRGAKVIARALKDAGMEVVYTGLRQTPEQIVRTAIQEDADVIGISILSGAHLELMPKIVEALKKAGLDDVGLVLGGVIPPEDIPKLKAMGVDDVFLPGTSLKEIAQRVSKLASTKRGIKVEG

SEQ ID NO: 12 - protein, 360 aa, Metallosphaera sedula
MKAAVLHTYKEPLSIEDVNISQPKAGEVKIKVKATGLCHSDVNVFEGKTPVPPPVVAGHEISGIVEEVGPGVTRVKPGDRVISAFIHPCGKCGNCVAGKENLCETFSQVRLKGVMPDGTSRLSKDGKEIRTFLGGGFAEYAIVGENALTRVPEDMDLEKVAVLGCAGLTGYGAISSSKIEPGDTVAVIGVGGVGLSTIQLLRASGAGRIIAVGTKKWKLDRAMELGATDVVNSKEIDPVKAIKEITGGGPQVVIEAGGNEDTIHMALDSVRIGGKVVLVGLPPATAMIPIRVASIVRGGIEVVGNYGGRPRVDMPKLLELVRQGRYDPSRLVTGRFRLEEINEAVKMLEEGEAIRSLIIP

SEQ ID NO: 13 - protein, 549 aa, Metallosphaera sedula
MGGFKIPNYEGVDPTGSWYSVLTPLLFLERAGKYFKDKTAVVYRDSRYTYSTFYDNVMVQASALMRRGFSREDKLSFISRNRPEFLESFFGVPYAGGVLVPINFRLSPKEMAYIINHSDSKFVVVDEPYLNSLLEVKDQIKAEIILLEDPDNPSASETARKEVRMTYRELVKGGSRDPLPIPAKEEYSMITLYYTSGTTGLPKGVMHHHRGAFLNAMAEVLEHQMDLNSVYLWTLPMFHAASWGFSWATVAVGATNVCLDKVDYPLIYRLVEKERVTHMCAAPTVYVNLADYMKRNNLKFSNRVHMLVAGAAPAPATLKAMQEIGGYMCHVYGLTETYGPHSICEWRREWDSLPLEEQAKLKARQGIPYVSFEMDVFDANGKPVPWDGKTIGEVVMRGHNVALGYYKNPEKTAESFRDGWFHSGDAAVVHPDGYIEIVDRFKDLINTGGEKVSSILVEKTLMEIPGVKAVAVYGTPDEKWGEVVTARIELQEGVKLTEEEVIKFCKERLAHFECPKIVEFGPIPMTATGKMQKYVLRNEAKAKANKEKS

SEQ ID NO: 14 - protein, 564 aa, Metallosphaera sedula
MVTVQDFFRKFIEFQNSPNEKSLQEIVKLVGQLDLRRFNWVRDVFEDIHVKERGSKTALIWRDINTGEEAKLSYHELSLMSNRVLSTLRKHGLKKGDVVYLMTKVHPMHWAVFLAVIKGGFVMVPSATNLTVAEMKYRFSDLKPSAIISDSLRASVMEEALGSLKVEKFLIDGKRETWNSLEDESSNAEPEDTRGEDVIINYFTSGTTGMPKRVIHTAVSYPVGSITTASIVGVRESDLHLNLSATGWAKFAWSSFFSPLLVGATVVGINYEGKLDTRRYLGEVENLGVTSFCAPPTAWRQFITLDLDQFRFERLRSVVSAGEPLNPEVIKIWKDKFNLTIRDFYGQTETTAMVGNFPFLKVKPGSMGKPHPLYDIRLLDDEGKEITKPYEVGHITVKLNPRPIGLFLGYSDEKKNMESFREGYYYTGDKAYFDEEGYFYFVGRGDDVIKTSDYRVGPFEVESALLEHPAVAEAAVVGVPDTVRWQLVKAYIVLKKGYMPSKELAEEIREKMKTLLSPYKVPRIIEFVDELPKTISGKIRRVELRKREEEKRKKGEVGQNEYVF

SEQ ID NO: 15 - protein, 507 aa, Metallosphaera sedula
MVVRTGEQYLQSISNRSKVEIYVMGREVKDVTKHPFLKPSVMSFKATFDAAWEEDTKELGRAWSPYLEEEINRFNHIHRSPDDLAAKVKLLRKLSHKTGACFQRCVGWDSLNTLHIVTTMMAKKGKTEVRDRFVEYLKYVQKNDLALAGAMTDAKGIRNLKPSQQPNKNAYLRITEVTKDGIYVSGAKANITGVAATEEMVVLPTRAMGPEDKDYAVAFAIPTDTEGVKIVVGRQLNDARRMEEGEIDGLPYFYNHEGLVIFDNVFVPMNRVFLAGEWEYTGTLVEIFSAYHRQGYGGCKAGLGDVIIGASADLAKQIGVDRASHVQDKLTEMIFLTETMYSAGIAASLNAVKMCDNCWWVNPMHANVTKHLVARFPSQIAQLSIDLAGGIVGTAPSEWDLKNPKLKEYISRYLQGAEDFTAEDRLRMVRLVENVSMGVAFQIESVHGAGSPAAQRIMFSRLYDLNFAQEVAKKLAGRKSEVKFTSKAEPWRESQSEAEAKEAGLKS

SEQ ID NO: 16 - protein, 651 aa, Metallosphaera sedula
MKVTVIGSGVMGHGIAELAAIAGNEVWMNDISTEILQQAMERIKWSLSKLRESGSLKEGVEQVLARIHPETDQAQALKGSDFVIEAVKEDLELKRTIFRNAEAHASPSAVLATNTSSLPISEIASVLKSPQRVVGMHFFNPPVLMPLVEIVRGKDTSDEVVKTTAEMAKSMNKETIVVKDVPGFFVNRVLLRIMEAGCYLVEKGIASIQEVDSSAIEELGFPMGVFLLADYTGLDIGYSVWKAVTARGFKAFPCSSTEKLVSQGKLGVKSGSGYYQYPSPGKFVRPTLPSTSKKLGRYLISPAVNEVSYLLREGIVGKDDAEKGCVLGLGLPKGILSYADEIGIDVVVNTLEEMRQTSGMDHYSPDPLLLSMVKEGKLGRKSGQGFHTYAHEEAKYSTIVVRVEPPLAWIVLNRPTRYNAINGDMIREINQALDSLEEREDVRVIAITGQGRVFSAGADVTEFGSLTPVKAMIASRKFHEVFMKIQFLTKPVIAVINGLALGGGMELALSADFRVASKTAEMGQPEINLGLIPGGGGTQRLSRLSGRKGLELVLTGRRVKAEEAYRLGIVEFLAEPEELESEVRKLANAIAEKSPLAVASAKLAYKLGEETHIWTGTSLEASLFGLLFSTKDFEEGVRAFLEKRKPNFRGE

SEQ ID NO: 17 - protein, 395 aa, Metallosphaera sedula
MPDVYIVSAVRTPIGRFGGSLKSVKPQMLGAIAIKEALRRANTDPSRVELTIMGNVLRSGHGQDLARQAALLAGIPWEVDGYCVDMVCSSGMMGVTNAAQMIKSGDADVVVAGGMESMSQSMLAVNSEVRWGVKFLSGKSLNFIDTMLVDGLTDPFNLKLMGQEADMVARERDISRRELDEVAFESHRRAHQAWEKGLFKSEVIPVNLDEGKLERDEGIRPDTTMEKLSSLKPAFTENGYHTAGNSSQISDGAVAMVLMSEKAVKEFGVDPVAKILGYSWVGIESWRFTEAPLYSVRKLLTRLNMNITQFDYFENNEAFAVNNVLFHRYLGVPYDQLNVFGGAIALGHPIGASGARIMVTLLNVLSKMNATRGIASICHGVGGSTAIALELLRPL

SEQ ID NO: 18 - protein, 664 aa, Metallosphaera sedula
MSQPENESGLPFQEKVVPELLKHRLVTPEEYLRIHKKTVENYQEYWESVAKELDWFKPWEKALDDSHPPFYKWFVGGELNASYLAVDRHANSWRRNKVAIIWEGEPWENGPKEVRKLTYLDLYREVNRAAYLLKEVYGLKKGDTIGIYLPMIPELPIFMLAAARLGVAFTVVFSGFSAQAVADRMNDADTKLLITADGGWRRGKVIPLKEIVDKALETATTVKNVLVVRRTGTEISMKPGRDAYLHDVMSKVPIKAYVEPERVKSEDPLYILYTSGTTGKPKGIIHDTGGYMTLLHNTMKLVFDIRDTDVFWCTADIGWVTGHSYIVFGPLQEGATEVMYEGALDFPEPDRWVSIIERHQVSILYTSPTAIRTFMKQGEQWIKKHDVSSVRLMHSVGEPINPEAWRWFHKLVGRGQVPFGSTWGMTETGGIMISHMPGGYLVPMKPGTNGPPLLGIETNVFDEEGKPMPEEQKGYLVITKPWPGMPLTINKDPERYVKVYWNKFPNVFYAGDYAIKDRDGYFWILGRADEVMKIAGHRIGTYELESALVQHPAIAEAAVVGVPDPVRGEVAEAFVILRSGVEPSAKLREEIVKFVRENFGPIAVFREIHFVSKLPKTRSGKIMRRVIKAVATNSPVGDVTTLEDEASVEEVKKAFQELKEQVGK

SEQ ID NO: 19 - protein, 19 aa, Metallosphaera sedula
CHVYGLTETYGPHSICEWR

SEQ ID NO: 20 - protein, 19 aa, Metallosphaera sedula
AVGYGMSETAPVLTVAYYT

SEQ ID NO: 21 - protein, 17 aa, Metallosphaera sedula
RDFYGQTETTAMVGNFP

SEQ ID NO: 22 - protein, 18 aa, Metallosphaera sedula
TDIYGQSETGYVVGTPFS

SEQ ID NO: 23 - protein, 18 aa, Metallosphaera sedula
GSTWWMTETGGIMISHMP

SEQ ID NO: 24 - protein, 15 aa, Metallosphaera sedula
ISVWGTTDGHMAVEV

SEQ ID NO: 25 - protein, 513 aa, Acidianus hospitalis
MVKMPPFGKVLVANRGEIAVRVMKAIKEMGMKAVAVYSEADKYALHVKYADEAYYIGKAPALDSYLNIDHIIDAAEKAHADAVHPGYGFLSENADFAAAVEKAGMTFIGPSSDVMNKIKDKLDGKRVAKMAGVPIAPGSDGPVSSLDEALKIAEKIGYPIMVKAASGGGGVGITRVDNPDQLVEVWERNKRLAYQAFGKADLYIEKYAVNPRHIEFQLIGDKYGDYVVAWERECTIQRRNQKLIEEAPSPALKMEEREKMFEPIMKFGQIIHYFTMGTFETAFSDVTREFYFLELNKRLQVEHPTTELIFRIDLVKLQILLAAGEHLPFTQEELNKRVRGAAIEYRINAEDPLNNFTGSSGYITYYKEPTGPGVRVDSGVEAGSWVPPFYDSLISKLIVYGESRAYAIQAGIRALNDYKIGGVKTTIELYKWIMRDPDFQEGRFSTSYIAQKTEQFTKYLRQQEELRAALALEIQSRGLNRQGATPVTTSQRQPKSAWKTYGLVSQASSRVMW

SEQ ID NO: 26 - protein, 510 aa, Sulfolobus islandicus
MPPFNKVLVANRGEIAIRVMKAVKEMGMKAVAVYSDADKYSPHVKYADEAYWIGPPPALESYLNIERIIDAAEKAHADAVHPGYGFLSENASFVEAVEKAGMVFIGPSASVMNRIKDKLEGKMIARKAGVPTSPGPLTPIENVDEALKIAGEIGYPIMLKAAGGGAGVGIIKVDNPSELAEAFERSKRLAYSAFGRAEIYIEKAAIKPKHIETQLIGDKYGNYVVSFERECTIQRRNQKLIEEAPSPSIKEEERKEIIEASIRFGKEINYFTLGTMEFVFSPVTREFYFLEINKRVQVEHTVTEFITGIDLVKLQIRLAAGEYLPFSQEDLKIRGHAIQFRINAEDPLNNFTPQSGYITYYKEPTGPGVRVDSGIELGSWVPPYYDPLVSKLIVYGQSRDYAIQVGLRALNDYKIGGVKTTIPLYKLILQDPDFWEGNFTTAYISEKAEYFTTKLKEEQEIQIAIAISIYNRGLMKKKKTEQKVPISTSNGKSNWKTYGIIFQSSPRVLW

SEQ ID NO: 27 - protein, 513 aa, Sulfolobus tokodaii
MPPFGKVLVANRGEIAVRVMKAIKEMGMKAVAVYSEADKYALHVKYADEAYYIGPPPALESYLNIQAIIDAAEKAHADAVHPGYGFLSENADFAEAVVKAGLTWIGPPVDAMRAIKSKLDGKRIAKQAGVPISPGSDGPVDSLDEALKLAEKIGYPIMVKAAFGGGGTGITRVDNPDQLVEVWERNKRLAYQAFGKADLYIEKAAVNPRHIEFQLIGDKYGNYVVAWERECTIQRRNQKLIEEAPSPALKMEERERMFEPIIKFGQIIHYYTLGTFETVFSDTTREFYFLELNKRLQVEHPITEMIFRIDLVKLQINIAAGEPLPFTQEELNKRVRGHAIEYRINAEDPLNDFTGSSGFITYYKEPTGPGVRVDSGVTLGSYVPPFYDSLISKLIVYGENRAYAIQAGIRALNDYKIGGVRTTIELYKWISQEEDFQKGKFSTAYIAEKREQYLKYLKAKEQMKAALAATLYQRGLLKKATTTVNSTQPQNQTKRSNWKTYGLLQQSSYRVMW

SEQ ID NO: 28 - protein, 512 aa, Metallosphaera yellowstonensis
MPPFGKVLVANRGEIAVRVMKAVKEMGMKAVAVYSEADKYALHVRYADEAYYIGASPALESYLNISHIIDAAEKAHADAVHPGYGFLSENADFAEAVEKAGMTYIGPSAEVMRKIKDKLDGKRYAQLSGVPIAPGSDGPVGTIDEALKIAEKIGYPIMVKAASGGGGVGITKVDTPDQLIDVWERNKRMALQAFGKSDLYIEKAAVNPRHIEFQLIGDKYGSYVVAWERECTIQRRNQKLIEEAPSPAITMEERSRMFEPIMKFGKLIDYFTLGTFETVFSDTSREFYFLELNKRLQVEHPVTEMIFRLDLVKLQIRLAAGEHLPFTQEELNRRAKGSAIEFRINSEDPLNNFTGSSGFITYYREPTGPGVRVDSGVEAGSWVPPFYDSLISKLIVYGEDRQTAVTTAMRALDDYKIGGVKTTIPLYKLIMRDPDFMEGKFSTAYISQKFDSMKEALKKREEMLASLATVVHARGLMRKKGIPSTPQERQGRSSNWKNYGIVLQSSPRVMWG

SEQ ID NO: 29 - protein, 510 aa, Sulfolobus acidocaldarius
MPPFGKVLVANRGEIAIRVMKAVKEMGMKAVAVYSEADKNSLHVKYADEAYYIGPSPAIQSYLNIESIISVAEKAHVDAVHPGYGFLSERADFAEAVEKAGVVFIGPSPHAMNSIKSKLDGKRLAKASGVPISPGSDGPVENLDEAIKIADRIGYPIMVKAAYGGGGTGITKVDSQEQLIEVWERNKRLAYQAFGKADLYIEKAAVNPRHIEFQLIGDKYGNYVVAWERECTIQRRNQKLIEEAPSPVVKMEERERMFEPIMKFGQLIRYHTLGTFETVFSDVSREFYFLELNKRLQVEHPITETIFRIDLVKLQIRLAADEHLPFTQEELNKRVRGHAIEYRINSEDPMSDFSGSSGTITYYEEPSGPGVRVDSGITLGSYVPPFYDSLIAKLIVYGEDRISALQSGQRALSDFKIGGVKTTIELYKWITREEDFVNAKFTTAYISQKSKEFLEYLKRKEMTKAVIASVMYSKGYVKKSGNGKKETVSNNKNKWKTYGIMSQSSYRVLW

SEQ ID NO: 30 - protein, 510 aa, Sulfolobus islandicus
MPPFNKVLVANRGEIAIRVMKAVKEMGMKAVAVYSDADKYAPHVKYADEAYWIGPPPALESYLNIERIIDAAEKAHADAVHPGYGFLSENAPFVEAVEKAGMVFIGPSASVMNRIKDKLEGKMIARKAGVPTSPGPLTPIENVDEALKIAGEIGYPIMLKAAGGGAGVGIIKVDNPSELAEAFERSKRLAYSAFGRAEIYIEKAAIKPKHIETQLIGDKYGNYVVAFERECTIQRRNQKLIEEAPSPSIKEEERKEIIEASIRFGKEINYFTLGTMEFVFSPVTREFYFLEINKRVQVEHTVTEFITGIDLVKLQIRLAAGEYLPFSQEDLKIRGHAIQFRINAEDPLNNFTPQSGYITYYKEPTGPGVRVDSGIELGSWVPPYYDPLVSKLIVYGQSRDYAIQVGLRALNDYKIGGVKTTIPLYKLILQDPDFWEGNFTTAYISEKAEYFTTKLKEEQEIQIAIAISIYNRGLMKKEKTEQKVPISTSNGKSNWKTYGIIFQSSPRVLW

SEQ ID NO: 31 - protein, 510 aa, Sulfolobus acidocaldarius; identical to SEQ ID NO: 29

SEQ ID NO: 32 - protein, 510 aa, Sulfolobus islandicus
MPPFNKVLVANRGEIAIRVMKAVKEMGMKAVAVYSDADKYAPHVKYADEAYWIGPPPALESYLNIERIIDAAEKAHADAVHPGYGFLSENASFVEAVEKAGMVFIGPSASVMNRIKDKLEGKMIARKAGVPTSPGPLTPIENVDEALKIAGEIGYPIMLKAAGGGAGVGIIKVDNPSELAEAFERSKRLAYSAFGSAEIYIEKAAIKPKHIETQLIGDKYGNYVVAFERECTIQRRNQKLIEEAPSPSIKEEERKEIIEASIRFGKEINYFTLGTMEFVFSPVTREFYFLEINKRVQVEHTVTEFITGIDLVKLQIRLAAGEYLPFSQEDLKKRGHAIQFRINAEDPLNNFTPQSGYITYYKEPTGPGVRVDSGIELGSWVPPYYDPLVSKLIVYGQSRDYAIRVGLRALNDYKIGGVKTTIPLYKLILQDPDFWEGNFTTAYISEKAEYFMTKLKEEQEIQIAIAISIYNRGLMKKKKTEQKVPISTSNGKSNWKTYGIIFQSSPRVLW

SEQ ID NO: 33 - protein, 510 aa, Sulfolobus islandicus
MPPFNKVLVANRGEIAIRVMKAVKEMGMKAVAVYSDADKYAPHVKYADEAYWIGPPPALESYLNIERIIDAAEKAHADAIHPGYGFLSENAPFVEAVEKAGMVFIGPSASVMNRIKDKLEGKMIARKAGVPTSPGPLTPIENVDEALKIAEEIGYPIMLKAAGGGAGVGIIKVDNPSELAEAFERSKRLAYSAFGRAEIYIEKAAIKPKHIETQLIGDKYGNYVVAFERECTIQRRNQKLIEEAPSPSIKEEERKEIIEASIRFGKEINYFTLGTMEFVFSPVTREFYFLEINKRVQVEHTVTEFITGIDLVKLQIRLAAGEYLPFSQEDLKIRGHAIQFRINAEDPLNNFTPQSGYITYYKEPTGPGVRVDSGIELGSWVPPYYDPLVSKLIVYGQSRDYAIQVGLRALNDYKIGGVKTTIPLYKLILQDPDFWEGNFTTAYISEKAEYFTTKLKEEQEIQIAIAISIYNRGLMKKKKTEQKLPISTSNGKSNWKTYGIIFQSSPRVLW

SEQ ID NO: 34 - protein, 510 aa, Metallosphaera cuprina
MPPFSRVLVSNRGEIAVRVMKAIKEMGMTAIAVYSEADKYALHVKYADEAYYIGPSPALESYLNIPRIIDAAEKAHADAIHPGYGFLSENADFVEAVEKAGITYIGPSADVMRKIKDKLDGKRIAVQAGVPIAPGSDGPVSSIDEALKLAERIGYPIMVKAASGGGGVGITKIDSPDQLIDAWERNKRLATQAFGKSDLYIEKAAVNPRHIEFQLIGDKYGNYVVAWERECTIQRRNQKLIEEAPSPAITMEERSKMFEPIMKYGHILNYFTLGTFETVFSDATREFYFLELNKRLQVEHPTTELIFRMDLVKLQIRLAAGEHLPFTQEELNKRARGASIEFRINAEDPLNDFSGSSGYITYYKEPSGPGVRTDSGVVEGSWVPPFYDSLISKLIVYGENRPYAIQTAIRALDDYKIGGVKTTISLYKLIMRDPDFQEGKFSTAYISQKMNSLTKKLRTEEEMLASIAVVLQSRGMLRKRAPVSQVQTKSESGWKSYGLIMQSSPRVMWR

SEQ ID NO: 35 - protein, 510 aa, Sulfolobus islandicus
MPPFNKVLVANRGEIAIRVMKAVKEMGMKAVAVYSDADKYAPHVKYADEAYWIGPPPALESYLNIERIIDAAEKAHADAVHPGYGFLSENASFVEAVEKAGMVFIGPSASVMNRIKDKLEGKMIARKAGVPTSPGPLTPIENVDEALKIAGEIGYPIMLKAAGGGAGVGIIKVDNPSELAEAFERSKRLAYSAFGRAEIYIEKAAIKPKHIETQLIGDKYGNYVVAFERECTIQRRNQKLIEEAPSPSIKEEERKEIIEASIRFGKEINYFTLGTMEFVFSPVTREFYFLEINKRVQVEHTVTEFITGIDLVKLQIRLAAGEYLPFSQEDLKIRGHAIQFRINAEDPLNNFTPQSGYITYYKEPTGPGVRVDSGIELGSWVPPYYDPLVSKLIVYGQSRDYAIQVGLRALNDYKIGGVKTTIPLYKLILQDPDFWEGNFTTAYISEKAEYFTTKLKEEQEIQIAIAISIYNRGLMKKKKTEQKVPISTSNGKSNWKTYGIIFQSSPRVLW

SEQ ID NO: 36 - protein, 510 aa, Sulfolobus solfataricus
MSPFNKVLVANRGEIAIRVMKAVKEMGMKAVAVYSDADKYAPHVKYADEAYWIGPPPALESYLNIERIIDAAEKAHADAVHPGYGFLSENASFVEAVEKAGMVFIGPSASVMNRIKDKLEGKMIARKAGVPTSPGPLTPIENVDEALKIAGEIGYPIMLKAAGGGAGVGIIKVDNPSELAEAFERSKRLAYSAFGRAEIYIEKAAIKPKHIETQLIGDKYGNYVVAFERECTIQRRNQKLIEEAPSPSIKEEERKEIIEASIRFGKEINYFTLGTMEFVFSPVTREFYFLEINKRVQVEHTVTEFITGIDLVKLQIRLAAGEYLPFSQEDLKIRGHAIQFRINAEDPLNNFTPQSGYITYYKEPTGPGVRVDSGIELGSWVPPYYDPLVSKLIVYGQSRDYAIQVGLRALNDYKIGGVKTTIPLYKLILQDPDFWEGNFTTAYISEKAEYFTTKLKEEQEIQIAIAISIYNRGLMKKKKTEQKVPISTSNGKSNWKTYGIIFQSSPRVLW

SEQ ID NO: 37 - protein, 510 aa, Sulfolobus islandicus
MPPFNKVLVANRGEIAIRVMKAVKEMGMKAVAVYSDADKYAPHVKYADEAYWIGPPPALESYLNIERIIDAAEKAHADAVHPGYGFLSENAPFVEAVEKAGMVFIGPSASVMNRIKDKLEGKMIARKAGVPTSPGPLTPIENVDEALKIAGEIGYPIMLKAAGGGAGVGIIKVDNPSELAEAFERSKRLAYSAFGRAEIYIEKAAIKPKHIETQLIGDKYGNYVVAFERECTIQRRNQKLIEEAPSPSIKEEERKEIIEASIRFGKEINYFTLGTMEFVFSPVTREFYFLEINKRVQVEHTVTEFITGIDLVKLQIRLAAGEYLPFSQEDLKIRGHAIQFRINAEDPLNNFTPQSGYITYYKEPTGPGVRVDSGIELGSWVPPYYDPLVSKLIVYGQSRDYAIQVGLRALNDYKIGGVKTTIPLYKLILQDPDFWEGNFTTAYISEKAEYFTTKLKEEQEIQIAIAISIYNRGLMKKKKTEQKLPISTSNGKSNWKTYGIIFQSSPRVLW

SEQ ID NO: 38 - protein, 506 aa, Sulfolobus solfataricus
MPPFNKVLVANRGEIAIRVMKAVKEMGMKAVGVYSDADKYALHVKYADEAYWIGPPPALESYLNIERIIDAAEKAHVDAIHPGYGFLSENASFVEAVEKAGITFIGPSASVMNKIKDKLEGKMIAKKAGVPISPGPLTPVDNVNEALKIAEEIGYPIMLKAAGGGAGVGIIKVDNPSELAEAFERSKRLAYSAFGRAEIYIEKAAIKPKHIETQLIGDKYGNYVVAFERECTIQRRNQKLIEEAPSPSIKEEERKEIIEASIRFGKEINYFTLGTMEFVFSPVTREFYFLELNKRVQVEHTVTEFITGIDLVKLQIRLASGEYLPFSQEDLKIRGHAIQFRINAEDPLNNFTPQSGYITYYREPTGPGVRVDSGIESGSWVPPYYDPLVSKLIVYGQNRDYAIQVGLRALNDYKIGGVKTTIPLYKLILQDPDFWEGNFTTAYISEKMEYFTTKLKEEQEMQIAMAISIFNRGLIKRKKTEQKVLTSKSNWKTYGIISQSSPKVLW

SEQ ID NO: 39 - protein, 510 aa, Sulfolobus islandicus; identical to SEQ ID NO: 30

SEQ ID NO: 40 - protein, 461 aa, Sulfolobus solfataricus
MPPFNKVLVANRGEIAIRVMKAVKEMGMKAVGVYSDADKYALHVKYADEAYWIGPPPALESYLNIERIIDAAEKAHVDAIHPGYGFLSENASFVEAVEKAGITFIGPSASVMNKIKDKLEGKMIAKKAGVPISPGPLTPVDNVNEALKIAEEIGYPIMLKAAGGGAGVGIIKVDNPSELAEAFERSKRLAYSAFGRAEIYIEKAAIKPKHIETQLIGDKYGNYVVAFERECTIQRRNQKLIEEAPSPSIKEEERKEIIEASIRFGKEINYFTLGTMEFVFSPVTREFYFLELNKRVQVEHTVTEFITGIDLVKLQIRLASGEYLPFSQEDLKIRGHAIQFRINAEDPLNNFTPQSGYITYYREPTGPGVRVDSGIESGSWVPPYYDPLVSKLIVYGQNRDYAIQVGLRALNDYKIGGVKTTIPLYKLILQDPDFWEGNFTTAYISWKTYGIISQSSPKVLW

SEQ ID NO: 41 - protein, 167 aa, Sulfolobus tokodaii
MKLLRVSSELGDSYVMTYDQQGNKDTVSFEDNKFEIEYIGPGWREGELLFKINGEVHRVYVDNGFIVIDDETIFKVDRITETPIEQGKSIEELIKGKEGEILSPMQGRIVQIRVKEGDAVNKGQPLLSIEAMKSETVISAPVGGVVQKIMVKPGQGVKKGDLLLIIK

SEQ ID NO: 42 - protein, 167 aa, Metallosphaera cuprina
MKLYRVHSEVGDTFIIAQDQGQNKDKVKTENNEFEIEYVGQGRREGEIILRVNGEEHRAVIDNGWIVLDNAKIFRAERITELPTQEGQSLEEMIKGKEGEVASPLQGRVVQIRVKEGDAVNKGQPLLSIEAMKSETVISAPISGIVEKILVKSGQGVKKGDILIVIK

SEQ ID NO: 43 - protein, 167 aa, Metallosphaera yellowstonensis
MKLYRVHSETGDPFVIVHDQKGNKDILKTENAEFEIEYLGQGWREGEYLVKINGEEHRVYVDNGWIVLDNAELFRAERITELPTQEGQSIEEMIRGKEGEVISPLQGRVVQIRVKEGDAVNKGQPLLSVEAMKSETIISAPISGIVEKILVKQGQGVKKGDVLIVIK

SEQ ID NO: 44 - protein, 186 aa, Sulfolobus solfataricus
MENLWYHIPILSKGVVVMRLFRLYSELGDMYLVSYEQSNNSLDKIKIGDKNYEVKYLGSGNRENEYLFEINGKKYYVFIESDGTLIFNHQDFLRLDKVTEIPIKGEERVEEIIRGKEGEIVSPLFGRVVKIRVKEGDAVNKGQPLLSIEAMKAETVISSPIGGIVQKILIKEGQGVKKGDILIVIK

SEQ ID NO: 45 - protein, 169 aa, Sulfolobus islandicus
MRLFRLYSELGDMYLVSYEQSNNSLDKIKIGDKNYEVKYLGPGNRENEYLFEINGKKYYVFIESDGTLIFNHQDFLRLDKVTEIPIKGEERVEEIIRGKEGEIVSPLFGRVVKIRVKEGDAVNKGQPLLSIEAMKAETVISSPIGGIVQKILIKEGQGVKKGDILIVIK

SEQ ID NO: 46 - protein, 169 aa, Sulfolobus solfataricus
MRLFRIYSELGDTFLVSYDQIGNNVDKIKIGDNIYEVKYLGPGNRENEYLFEVNGKKYYVYMEQDGTLIFNNQDFLRLDKVTEIPVKGEERVEEIIRGKEGEIVSPLFGRVVKIRVKEGDAVNKGQPLLSIEAMKAETVLSSPIGGIVQKILVKEGQGVKKGDILVVIK

SEQ ID NO: 47 - protein, 169 aa, Sulfolobus islandicus; identical to SEQ ID NO: 45

SEQ ID NO: 48 - protein, 169 aa, Sulfolobus islandicus
MRLFRLYSELGDMYLVSYEQSNNSLDKIKIGDKNYEVKYLGSGNRENEYLFEINGKKYYVFIESDGTLIFNHQDFLRLDKVTEIPIKGEERVEEIIRGKEGEIVSPLFGRVVKIRVKEGDAVNKGQPLLSIEAMKAETVISSPIGGIVQKILIKEGQGVKKGDILIVIK

SEQ ID NO: 49 - protein, 169 aa, Sulfolobus islandicus
MRLFRLYSELGDMYLVSYEQSNNSLDKIKIGDKNYEVKYLGSGNRENEYLFEINGKKYYVFIESDGTLIFNHQDFLRLDKVTEIPIKGEERVEEIIRGKEGEIVSPLFGRVVKIRVKEGDAVNKGKPLLSIEAMKAETVISSPIGGIVQKILIKEGQGVKKGDILVVIK

SEQ ID NO: 50 - protein, 169 aa, Sulfolobus islandicus; identical to SEQ ID NO: 48

SEQ ID NO: 51 - protein, 169 aa, Sulfolobus islandicus
MRLFRLYSELGDMYLVSYEQSNNSLDKIKIGDKNYEVKYLGPSNRENEYLFEINGKKYYVFIESDGTLIFNHQDFLRLDKVTEIPIKGEERVEEIIRGKEGEIVSPLFGRVVKIRVKEGDAVNKGQPLLSIEAMKAETVISSPIGGIVQKILIKEGQGVKKGDILIVIK

SEQ ID NO: 52 - protein, 169 aa, Sulfolobus islandicus; identical to SEQ ID NO: 51

SEQ ID NO: 53 - protein, 169 aa, Sulfolobus solfataricus; identical to SEQ ID NO: 46

SEQ ID NO: 54 - protein, 169 aa, Sulfolobus islandicus; identical to SEQ ID NO: 48

SEQ ID NO: 55 - protein, 167 aa, Sulfolobus acidocaldarius
MKIIKVVTDQGDSYTFATEKRDNKDLMKAEGAEFEVEYLGAGWREGEHLVKVNGEVHTVSIINGHLVIDNETLFKVDRVIEESLGEKVSFEELFKGKEGEIVSPLQGRIVQIRVKEGDAVNKGQPLLSIEAMKSETVISAPKGGVVKKVLIKPGQGVKKGDLLLIIE

SEQ ID NO: 56 - protein, 167 aa, Sulfolobus acidocaldarius; identical to SEQ ID NO: 55

SEQ ID NO: 57 - protein, 523 aa, Sulfolobus tokodaii
MSMYEKPPVEKLIEELRQLKEKAYKGGGDERIQFQHSKGKLTARERLALLFDDGKFNEIMTFATTRATEFGLDKQRFYGDGVVTGWGKVDGRTVFAYAQDFTVLGGSLGETHANKIVRAYELALKVGAPVVGINDSGGARIQEGALSLEGYGAVFKMNVMASGVIPQITIMAGPAAGGAVYSPALTDFIIMIKGDAYYMFVTGPEITKVVLGEEVSFQDLGGAVVHATKSGVVHFMVDSEQEAINLTKRLLSYLPSNNMEEPPYIDTGDPADRDATGVEQIVPNDAAKPYNMREIIYKIVDNGEFLEVHKHWAQNIIVGFARIAGNVVGIVANNPEEFGGSIDIDAADKAARFIRFCDAFNIPLISLVDTPGYVPGTDQEYKGIIRHGAKMLYAFAEATVPKITVIVRKSYGGAHIAMSIKSLGADLVYAWPTAEIAVTGPEGAVRILYRKEIQQASNPDDVLKQRIAEYRKLFANPYWAAEKGLVDDVIEPKDTRRVIVAGLEMLKTKREYRYPKKHGNIPL

SEQ ID NO: 58 - protein, 524 aa, Metallosphaera yellowstonensis
MATTYEKPDMGRLIEELRSLKAKAYQGGGEDRIKFQHSKGKLTARERLALLFDEGTFNEIMTFATTKATEFGLDKNRVYGDGVVTGWGKVEGRTVFAFAQDFTSIGGTLGETHASKITRIYEMALKVGAPVIGINDSGGARIQEGAVALEGYGAVFKANVMASGVVPQITIMAGPAAGGAVYSPALTDFIIMIKGDAYYMFVTGPEITKVVLGEDVSFQDLGGAIIHATKSGVVHFVAENENDAINITKRLLSYLPSNNMEDPPFLDTGDPSDREVKDVESVVPTDTVKPFDMREVIYRVVDNGEFMEVQRHWAQNMVVGFARMAGNVVGIVANNSAHLGAAIDIDAADKASRFIRFCDAFNIPLISLVDTPGYMPGTDQEYKGIIRHGAKMLYAFAEATVPKITVVIRRSYGGAHIAMSIKSLGADLIYAWPSAEIAVTGPEGAVRILYRREIQNSKSPDDFIKERISEYKKLFANPYWAAEKGLIDDVIEPKDTRKVIVSALDTLKNKREFRYPKKHGNIPL

SEQ ID NO: 59 - protein, 524 aa, Metallosphaera cuprina
MTATFEKQDMSKLIEELRNLKAKAYKGGGEERIQFQHNKGKLTARERLNLLFDEGTFNEVLTFATTKATEFNLDKNRVYGDGVVTGWGQVEGRTVFAFAQDFTSIGGTLGETHASKIAKVYELALKTGAPVIGINDSGGARIQEGAVALEGYGTVFKANVMASGVIPQITIMAGPAAGGAVYSPALTDFIIMIKGEAYYMFVTGPEITKVVLGEEVSFQDLGGAVIHATKSGVVHFVAENEQDSINIAKRLLSYLPSNNMEEPPFVDTGDPMDREMKDVETIVPTDTVKPFDIREVIYRTVDNGEFMEVQKHWAQNMVVGFARMAGNVVGIVANNSAHLGAAIDIDASDKAARFIRFCDAFNIPLVSLVDTPGYMPGTDQEYKGIIRHGAKMLYAFSEATVPKVTVVVRRSYGGAHIAMSIKSLGADLIYAWPSAEIAVTGPEGAVRILYRREIQNSKSPDDFIKERIAEYKKLFANPYWAAEKGLIDDVIEPKDTRKVIVSALRMLKNKREFRYPKKHGNIPL

SEQ ID NO: 60 - protein, 523 aa, Sulfolobus islandicus
MALYEKPSMDKLIEDLKILKEKVYKGGGEEKINFQHGKGKLTARERLNQLFDEGKFNEILTFATTRATEFGLDKNRFYGDGVIAGWGKIDGRQVFAYAQDFTILGGSLGETHANKIVRAYELALKVGAPVIGINDSGGARIQEGALSLEGYGAVFKMNVMASGVIPQITIMAGPAAGGAVYSPALTDFLIMIKGDAYYMFVTGPEITKVSIGEEVSYQNLGGAIIHATKSGVVHFVAENEQDAINITKRLLSYLPSNNMEEPPYVDTGDPADRAVQSAESIVPTDSVKPFDIRDLIYNIVDNSEFLEVHKLWAQNITVGFGRLNGNVVGIVANNSAYYGGAIDIDAADKAARFIRFCDAFNIPVISLVDTPGYVPGTDQEYKGIIRHGAKMLYAFAEATVPKITVIVRRSYGGAHIAMSIKSLGADLVYAWPSAEIAVTGPEGAVRILYRREIQSAQNPEELLKQKITEYKKLFANPYWAAEKGLIDDVIEPKDTRKVIARGLEMLRNKREFRYPKKHGNIPL

SEQ ID NO: 61 - protein, 523 aa, Sulfolobus islandicus
MALYEKPSMDKLIEDLKILKEKVYKGGGEEKINFQHGKGKLTARERLNQLFDEGKFNEILTFATTRATEFGLDKNRFYGDGVIAGWGKIDGRQVFAYAQDFTILGGSLGETHANKIVRAYELALKVGAPVIGINDSGGARIQEGALSLEGYGAVFKMNVMASGVIPQITIMAGPAAGGAVYSPALTDFLIMIKGDAYYMFVTGPEITKVSIGEEVSYQDLGGAIIHATKSGVVHFVAENEQDAINITKRLLSYLPSNNMEEPPYVDTGDPADRAVQSAESIVPTDSVKPFDIRDLIYNIVDNSEFLEVHKLWAQNITVGFGRINGNVVGIVANNSAYYGGAIDIDAADKAARFIRFCDAFNIPVISLVDTPGYVPGTDQEYKGIIRHGAKMLYAFAEATVPKITVIVRRSYGGAHIAMSIKSLGADLVYAWPSAEIAVTGPEGAVRILYRREIQSAQNPEELLKQKITEYKKLFANPYWAAEKGLIDDVIEPKDTRKVIARGLEMLRNKREFRYPKKHGNIPL

SEQ ID NO: 62 - protein, 523 aa, Sulfolobus islandicus
MALYEKPSMDKLIEDLKILKEKVYKGGGEEKINFQHGKGKLTARERLNQLFDEGKFNEILTFATTRATEFGLDKNRFYGDGVIAGWGKIDGRQVFAYAQDFTILGGSLGETHANKIVRAYELALKVGAPVIGINDSGGARIQEGALSLEGYGAVFKMNVMASGVIPQITIMAGPAAGGAVYSPALTDFLIMIKGDAYYMFVTGPEITKVSIGEEVSYQDLGGAIIHATKSGVVHFVAVNEQDAINITKRLLSYLPSNNMEEPPYVDTGDPADRAVQSAESIVPTDSVKPFDIRDLIYNIVDNSEFLEVHKLWAQNITVGFGRINGNVVGIVANNSAYYGGAIDIDAADKAARFIRFCDAFNIPVISLVDTPGYVPGTDQEYKGIIRHGAKMLYAFAEATVPKITVIVRRSYGGAHIAMSIKSLGADLVYAWPSAEIAVTGPEGAVRILYRREIQSAQNPEELLKQKITEYKKLFANPYWAAEKGLIDDVIEPKDTRKVIARGLEMLRNKREFRYPKKHGNIPL

SEQ ID NO: 63 - protein, 523 aa, Sulfolobus islandicus; identical to SEQ ID NO: 61

SEQ ID NO: 64 - protein, 523 aa, Sulfolobus islandicus; identical to SEQ ID NO: 61

SEQ ID NO: 65 - protein, 523 aa, Sulfolobus islandicus; identical to SEQ ID NO: 61

SEQ ID NO: 66 - protein, 523 aa, Sulfolobus solfataricus
MSLYEKPPMDKLIEDLKILKEKAYKGGGEERVNFQHSKGKLTARERLNLLFDEGTFNEILTFATTRATEFGLDRNKFYGDGVIAGWGKVDGRQVFAYAQDFTVLGGSLGETHANKIVRAYELALKVGAPVIGINDSGGARIQEGALSLEGYGAVFKMNVMASGVIPQITIMAGPAAGGAVYSPALTDFLIMIKGDAYYMFVTGPEITKVSIGEEVSYQDLGGAIVHATKSGVVHFVAENEQDAINIAKRLLSYLPSNNMEEPPYIDTGDPADREVQGAESIVPTDSVKPFDIRDLIYNIVDNSEFLEVHKLWAQNITVGFGRINGNVVGIIANNSAYYGGAIDIDAADKAARFIRFCDAFNIPLISLVDTPGYVPGTDQEYKGIIRHGAKMLYAFAEATVPKITVIVRRSYGGAHIAMSIKSLGADLVYAWPSAEIAVTGPEGAVRILYRREIQNAQNPEEFLKQKIAEYKKLFANPYWAAEKGLIDDVIEPKDTRKVISRGLEILRNKREFRYPKKHGNIPL

SEQ ID NO: 67 - protein, 523 aa, Sulfolobus solfataricus; identical to SEQ ID NO: 66

SEQ ID NO: 68 - protein, 523 aa, Sulfolobus islandicus; identical to SEQ ID NO: 61

SEQ ID NO: 69 - protein, 523 aa, Sulfolobus islandicus; identical to SEQ ID NO: 61

SEQ ID NO: 70 - protein, 523 aa, Sulfolobus islandicus; identical to SEQ ID NO: 61

SEQ ID NO: 71 - protein, 522 aa, Acidianus hospitalis
MSQEEKTMDKLIQELKNMKEKAYQGGGEDRIKAQHSKGKLTARERLALLFDEGTFNEIMTFATTKATEFGLDKMKMYGDGVVTGWGKVDGRTVFAYSQDFTELGGTLGEMHANKIAKVYELALKVGAPVVGINDSGGARIQEGAVALEGYGQVFKMNVMASGVIPQITIMAGPAAGGAVYSPALTDFIIMIKGDAYYMFVTGPEITKVVLGEEVSFQDLGGAVIHATKSGVVHFLAENEQDAINIAKRLLSYLPSNNMEEPPFMDTGDPADRDVKDVEQIVPTDSAKPFDMKEIIYRIVDNGEFLEVHKHWAQNIVVGFARIAGNVVGIVANNSQYLGAAIDIDAADKAARFIRFCDAFNIPLISLVDTPGYIPGTDQEYKGIIRHGAKMLYAFAEATVPKITVIIRKSYGGAHIAMSIKSLGADLVYAWPTAEIAVTGPEGAVRILYKKEIQASSNPDEFIKQKIAEYRKLFANPYWSAEKGLIDDVIEPKDTRRVIVSALEMLRNKREYRYPKKHGNIPL

SEQ ID NO: 72 - protein, 511 aa, Sulfolobus acidocaldarius
MEELKKKKELVYKGGGEERIKAQHDKGKLTARERLSLLFDGNTFQEFMGFATTKATEFGLDKNKVYGDGVVTGWGKVEGRTVFAYAQDFISLGGTLGEVHANKIARVYELALKTGAPVVGINDSGGARIQEGAVALEGYGAVFKMNVMASGVIPQITIMAGPAAGGAVYSPALTDFIIMIKGDAYYMFVTGPEITKVALGEEVSYQDLGGAIVHSTKSGVIHFMAENEQDAINITKKLLSYLPSNNMEEPPYIDTGDAADRDVSGANDIIPTDPVKPYSMRELIYRTVDNGEFMEVHKYWANNMIIGFARIGGNVVGIVANNPEEFGGAIDVDAADKAARFIRFCDAFNIPLISLVDTPGYVPGTEQEYKGIIRHGAKMLYAFAEATVPKITVILRKSYGGAHIAMSIKSLGADLVYAWPNAEIAVTGPEGAVRILYKRDLQKMSNPEDYIKQKIEEYRRLFANPYWAAEKGLIDDVIEPKDTRRIIYSALEMLKNKREYRYPKKHGNIPL

SEQ ID NO: 73 - protein, 511 aa, Sulfolobus acidocaldarius; identical to SEQ ID NO: 72

SEQ ID NO: 74 - protein, 523 aa, Sulfolobus solfataricus
MALYEKPSMDKLIEDLKILKEKVYKGGGEEKINFQHGKGKLTARERLNQLFDEGKFNEILTFATTRATEFGLDKNRFYGDGVIAGWGKIDGRQVFAYAQDFTILGGSLGETHANKIVRAYELALKVGAPVIGINDSGGARIQEGALSLEGYGAVFKMNVMASGVIPQITIMAGPAAGGAVYSPALTDFLIMIKGDAYYMFVTGPEITKVSIGEEVSYQDLGGAIIHATKSGVVHFVAENEQDAINITKRLLSYLPSNNMEEPPYVDTGDPADRAVQSAESIVPTDSVKPFDIRDLIYNIVDNSEFLEVHKLWAQNITVGFGRINGNVVGIVANNSAYYGGAIDIDAADKAARFIRFCDAFNIPVISLVDTPGYVPGTDQEYKGIIRHGAKMLYAFAEATVPKITVIVRRSYGGAHIAMSIKSLGADLVYAWPSAEIAVTGPEGAVRILYRREIQSAQNPEELLKQKITEYKKLFANPYWAAEKGLIDDVIEPKDTRNVIARGLEMLRNKREFRYPKKHGNIPL

SEQ ID NO: 75 - protein, 356 aa, Sulfolobus tokodaii
MRRTLKAAILGATGLVGIEYVRMLSNHPYIKPAYLAGKGSVGKPYGEVVRWQTVGQVPKEIADMEIKPTDPKLMDDVDIIFSPLPQGAAGPVEEQFAKEGFPVISNSPDHRFDPDVPLLVPELNPHTISLIDEQRKRREWKGFIVTTPLCTAQGAAIPLGAIFKDYKMDGAFITTIQSLSGAGYPGIPSLDVVDNILPLGDGYDAKTIKEIFRILSEVKRNVDEPKLEDVSLAATTHRIATIHGHYEVLYVSFKEETAAEKVKETLENFRGEPQDLKLPTAPSKPIIVMNEDTRPQVYFDRWAGDIPGMSVVVGRLKQVNKRMIRLVSLIHNTVRGAAGGGILAAELLVEKGYIEK

SEQ ID NO: 76 - protein, 352 aa, Sulfolobus acidocaldarius
MRRVYKAAILGSTGLVGIEYVRMLANHPYIKPTYLAGRGSVGKPYGEVVRWQTIGQIPKEIANQEIRPTDPKQMDDVDLVFSPLPAGSAAQVEDEFAKLGFKVISNSPDHRLEPDIPLIIPEVNPHSLNLIEEQKKRRDWEGFIVTTPLCTAQGVLIPLVPIYQNFRVQSVFITTMQALSGAGYPGVASLDVIDNILPLGNEYDAKMVKEMTKVLNSTKRNVSDESNINISTTTHRVPTIHGHYAVVYVTFKENVDLGKIRESLVNFSGEPQALKLPTAPEKVIVLTEQDNRPQVYFDRWLGDPPGMSVIVGRLTQVDNNAIRFVSLIHNSVRGAAGGGILTAELLINRKYI

SEQ ID NO: 77 - protein, 355 aa, Acidianus hospitalis
MRRILKAAILGATGLVGIEYVRMLSQHPYIKPAYLAGKGSVGKPYSEVVRWQTIGQVPKEVADMEVKPTDPKLMDDVDIVFSPLPQGAAGPIEEQFAKEGFPVISNSPDHRFDPDVPMLIPELNSHTISLIDEQRKKRDWKGFIVTTPLCTAQGAAIPLAPIFMNFKMTGAYITTIQSLSGAGYPGIPSLDVVDNILPLGDKYDAKTIKEITRILSEVKRNVNDPPLEEVALDATTHRIATVHGHYEVSYVTFKEDVNVEKIRETLENFRGEPQDLKLPTAPEKPIIVRNEDTRPQVYFDRWAGDPPGMSVVVGRLKQISNRTIRMVSLIHNTIRGAAGGGILTAELLIAKGYIE

SEQ ID NO: 78 - protein, 355 aa, Sulfolobus islandicus
MRRTLKAAILGSTGLVGIEYVRMLANHPYIKVGYLAGKGSVGKPYEEVVRWQTVGQVPKEIADMEVKPTDPKLMDDVDIIFSPLPQGAAGPVEEEFAKHGFPVISNSPDHRFDPDVPLLIPEINPHTISLIDKQRERHDWRGFIVTTPLCTAQGAAIPLAPIYMNFRIDSSLITTIQSLSGAGYPGIPSLDVVDNVLPLGDNYDNKTVKEISRILSETKRMVNDDNDLSLGATTHRIATIHGHYEVIYVTFRDDVSVEKIRETLDSFRGEPQKLKLPTAPDKPILLTNQDARPQVYFDRWAGDPPGMSVVVGRLSQINRRTIRLVSVVHNTVRGAAGGGILAAELLVEKGYIDKR

SEQ ID NO: 79 - protein, 356 aa, Sulfolobus solfataricus
MRRTLKAAILGSTGLVGIEYVRMLANHPYIKVGYLAGKGSVGKPYGEVVRWQTIGQVPTEIADMEVKPTDPKLMDDVDIVFSPLPQGAAGPVEEEFAKHGFPVISNSPDHRFDPDVPLLIPEVNPHTISLIDKQRERRDWRGFIVTTPLCTAQGAAIPLAPIYMNFKIDSSLITTIQSLSGAGYPGIPSLDVIDNVLPLGDNYDNKTVKEISRILSETKRMVDDDDNNLSLGATTHRVATIHGHYEVIYITFKEDVTVEKIGETLDSFRGEPQNLKLPTAPDKPILLINQDARPQVYFDRWAGNPPGMSVVVGRLGQINRRTIRLVSVIHNTVRGAAGGGILATELLIEKGYIDKR

SEQ ID NO: 80 - protein, 356 aa, Sulfolobus solfataricus; identical to SEQ ID NO: 79

SEQ ID NO: 81 - protein, 355 aa, Sulfolobus islandicus
MRRTLKAAILGSTGLVGIEYVRMLANHPYIKVGYLAGKGSVGKPYEEVVRWQTVGQVPKEIADMEVKPTDPKLMDDVDIIFSPLPQGAAGPVEEEFAKHGFPVISNSPDHRFDPDVPLLIPEINPHTISLIDKQRERHDWRGFIVTTPLCTAQGAAIPLAPIYMNFRIDSSLITTIQSLSGAGYPGIPSLDVVDNVLPLGDNYDNKTVKEISRILSETKRMVNDDNDLSLGATTHRISTIHGHYEVIYVTFREDVSVEKIRETLDSFRGEPQKLKLPTAPDKPILLTNQDARPQVYFDRWAGDPPGMSVVVGRLSQINRRTIRLVSVVHNTVRGAAGGGILAAELLVEKGYIDKR

SEQ ID NO: 82 - protein, 355 aa, Sulfolobus islandicus
MRRTLKAAILGSTGLVGIEYVRMLANHPYIKVGYLAGKGSVGKPYEEVVRWQTVGQVPKEIADMEVKPTDPKLMDDVDIIFSPLPQGAAGPVEEEFAKHGFPVISNSPDHRFDLDVPLLIPEINPHTISLIDKQRERHDWRGFIVTTPLCTAQGAAIPLAPIYMNFRIDSSLITTIQSLSGAGYPGIPSLDVVDNVLPLGDNYDNKTVKEISRILSETKRMVNDDNDLSLGATTHRISTIHGHYEVIYVTFREDVSVEKIRETLDSFRGEPQKLKLPTAPDKPILLTNQDARPQVYFDRWAGDPPGMSVVVGRLSQINRRTIRLVSVVHNTVRGAAGGGILAAELLVEKGYIDKR

SEQ ID NO: 83 - protein, 355 aa, Sulfolobus islandicus; identical to SEQ ID NO: 81

SEQ ID NO: 84 - protein, 354 aa, Sulfolobus acidocaldarius
MRRVLKAAILGSTGLVGIEYVRMLANHPYIKVAYLAGKGSVGKPYGEVVRWQTIGQIPKEVANMEIKPTDPKLMDDVDLVFSPLPAGAAGPVEEEFAKHGFKVISDSPDHRFEPDIPLLIPEINPHTITLIDEQRKKRDWKGFIVTTPLCAAQGVLLPLAPIYQNFKVDSVFITTMQAVSGEGYPGVASLDIIDNIKVLGENYDNKLIKEVHRVLSETKRNVNDSGNDVTLSATTHRVATIHGHYEIIYVTFKEDVNVEKVREAMDNFKGEPQNLKLPTAPSKPIILTNEDSRPQVYFDRWAGEIPGMSVVVGRLSQVNRRAIRFASLIHNTVRGAAGGGILATEFLVEKGYMD

SEQ ID NO: 85 - protein, 355 aa, Sulfolobus islandicus; identical to SEQ ID NO: 81

SEQ ID NO: 86 - protein, 355 aa, Sulfolobus islandicus
MRRTLKAAILGSTGLVGIEYVRMLANHPYIKVGYLAGKGSVGKPYEEVVRWQTVGQVPKEITDMEVKPTDPKLMDDVDIIFSPLPQGAAGPVEEEFAKHGFPVISNSPDHRFDPDVPLLIPEINPHTISLIDKQRERHDWRGFIVTTPLCTAQGAAIPLAPIYMNFRIDSSLITTIQSLSGAGYPGIPSLDVVDNVLPLGDNYDNKTVKEISRILSETKRMVNDDNDLSLGATTHRIATIHGHYEVIYVTFRDDVSVEKIRETLDSFRGEPQKLKLPTAPDKPILLTNQDARPQVYFDRWAGDPPGMSVVVGRLSQINRRTIRLVSVVHNTVRGAAGGGILAAELLVEKGYIDKR

SEQ ID NO: 87 - protein, 352 aa, Sulfolobus acidocaldarius; identical to SEQ ID NO: 76

SEQ ID NO: 88 - protein, 354 aa, Sulfolobus acidocaldarius; identical to SEQ ID NO: 84

SEQ ID NO: 89 - protein, 355 aa, Sulfolobus islandicus; identical to SEQ ID NO: 78

SEQ ID NO: 90 - protein, 355 aa, Sulfolobus islandicus
MRRTLKAAILGSTGLVGIEYVRMLANHPYIKVGYLAGKGSVGKPYEEVVRWQTVGQVPKEIADMEVKPTDPKLMDDIDIIFSPLPQGAAGPVEEEFAKHGFPVISNSPDHRFDPDVPLLIPEINPHTISLIDKQRERHDWRGFIVTTPLCTAQGAAIPLAPIYMNFRIDSSLITTIQSLSGAGYPGIPSLDVVDNVLPLGDNYDNKTVKEISRILSETKRMVNDDNDLSLGATTHRISTIHGHYEVIYVTFREDVSVEKIRETLDSFRGEPQKLKLPTAPDKPILLTNQDARPQVYFDRWAGDPPGMSVVVGRLSQINRRTIRLVSVVHNTVRGAAGGGILAAELLVEKGYIDKR

SEQ ID NO: 91 - protein, 355 aa, Sulfolobus islandicus; identical to SEQ ID NO: 78

SEQ ID NO: 92 - protein, 356 aa, Sulfolobus solfataricus; identical to SEQ ID NO: 79

SEQ ID NO: 93 - protein, 357 aa, Metallosphaera yellowstonensis
MRRTLKAAILGATGLVGIEYVRMLADHPYIRPAYLAGKGSVGKPYGEIVRWQTIGSVPKGIADQEVKPTDPKLMDDVDIVFSPLPQGAAGPVEEQFAKLGFYVISNSPDHRFDMDVPMMIPEVNPHTASLIDEQRRRRDWKGFIVTTPLCTAQGASIPLAPIFMNFKMNGVMLTTMQSLSGAGYPGIASLDIVDNALPLGDGYDAKTVKEVTRILSEVRRRIQDPPLEEVTLDATTHRIATIHGHYEVAYVTFKEDTDVHKVKEAMEGFIGEPQELKLPSAPERPILITDQDARPQVFFDRWAGNPPGMSVVVGRLKQVNRRTVRFVSLIHNTVRGAAGGGILTAELLVEKGYIDKR

SEQ ID NO: 94 - protein, 357 aa, Metallosphaera cuprina
MRRTLKAAILGATGLVGIEYVRMLADHPYIKPAYLAGKGSVGKPYGEIVRWQTMGTVPKEIANQEVKPTDPKLMDDVDIVFSPLPQGAAGPVEEQFAKLGFNVISNSPDHRFDMDVPMIIPEVNPHTVTLIDEQRKRRDWKGFIATTPLCTAQGAAIPLTPIYQNFKMNGVMITTMQSLSGAGYPGIASLDIVDNALPLGDGYDAKTVKEITRILSEVRRNVKEPGINEVTLDATTHRIATIHGHYEVAYVTFKEETNVMKVMETMENFRGEPQELKLPTAPDKPIIVTTQDARPQVFFDRWSGNPPGMSVVVGRLKQVNPKTMRFVSLIHNTVRGAAGGGVLTAELLVEKGYIDKR

SEQ ID NO: 95 - protein, 314 aa, Metallosphaera yellowstonensis
MIRRAAVVGAGVIGAGWTTLLASKGYEVSFYTEKEETLTKGLAKVRGYLEVMKTNSLIQEDVENVMKRISTFNDLESSVKGADIVIEAIIEDYGAKKALFSKLDKMLHGDVILASSTSGLLMTEIQKAMERHPERGVIAHPWNPPHLLPLVEVVPGEKTSQETLDRTKDFMEKLDRVVVVLKKEVPGFLGNRLAFALFREAVHLVDEGVATVEDIDKVMTAAIGLRWAFMGPFLTYHLGGGEGGLEYFFSRGFGYGANEWMHTLAKFDKFPYTAVKKAVEQMKEYAFIKDKSFQELSRWRDKKLLDVYRVVWSK

SEQ ID NO: 96 - protein, 324 aa, Sulfolobus solfataricus
MFIHMKSINKVAVIGAGVIGVGWTTLLLAKGYKVNLYTEKKETLEKALAKVSAYLVNLKNLGMINEEPESYITNLTGITKIDDAIHNVDFVIEAIIEDYTAKKNLFKLLDTQLPQDIIIASSTSGLLMTEIQKAMIRHPERGVIAHPWNPPHLLPLVEIVPGEKTSKETVDLTREFMEKLDRVVVLLRKEVPGFIGNRLAFALFREAVNLVDEGVATVEDIDKVMTAAIGLRWAFMGPFLTYHLGGGEGGIEYFFSKGFGYGANEWMHTLAKWDKFPYTAVKKVLEQMKEYEFIKGKSFQDLSRWRDEKLVTIYKAVYKEKCNS

SEQ ID NO: 97 - protein, 324 aa, Sulfolobus solfataricus; identical to SEQ ID NO: 96

SEQ ID NO: 98 - protein, 322 aa, Sulfolobus islandicus
MFIHMKSINKVAVVGAGIIGVGWTTLLLTKGYKVNLYTEKKETLEKGLAKVSAYLVNLKNLRMIDEEPIDYQRNLTGTTKIDEAIQNVEFVIEAIIEEYSAKKNLFNYLDSQLPRDIIIASSTSGLLMTEIQKAMTRYPDRGVIAHPWNPPHLLPLVEIVPGDKTSKYTLDVTKDFMEKLDRVVVVLKKEVPGFIGNRLAFALFREAVNLIDEGVATVEDIDKVMTAAIGLRWAFMGPFLTYHLGGGEGGIEYFFSKGFGYGANEWMYTLAKWDKFPYTAVKKIVDQMKEYEFIKGKNFQDLSRWRDETLVRVYKAVFGEKR

SEQ ID NO: 99 - protein, 322 aa, Sulfolobus islandicus
MFIHMKSINKVAVVGAGIIGVGWTTLLLTKGYKVNLYTEKKETLEKGLAKVSAYLVNLKNLRMIDGEPIDYQRNLTGTTKIDEAIQNVEFVIEAIIEDYSAKKNLFNYLDSQLPRDIIIASSTSGLLMTEIQKAMTRYPDRGVIAHPWNPPHLLPLVEIVPGDKTSKYTLDVTKDFMEKLDRVVVVLKKEVPGFIGNRLAFALFREAVNLIDEGVATVEDIDKVMTAAIGLRWAFMGPFLTYHLGGGEGGIEYFFSKGFGYGANEWMYTLAKWDKFPYTAVKKIVDQMKEYEFIKGKNFQDLSRWRDETLVRVYKAVFGEKR

SEQ ID NO: 100 - protein, 322 aa, Sulfolobus islandicus; identical to SEQ ID NO: 99

SEQ ID NO: 101 - protein, 322 aa, Sulfolobus islandicus; identical to SEQ ID NO: 99

SEQ ID NO: 102 - protein, 322 aa, Sulfolobus islandicus; identical to SEQ ID NO: 98

SEQ ID NO: 103 - protein, 322 aa, Sulfolobus islandicus
MFIHMKSINKVAVVGAGIIGVGWTTLLLTKGYKVNLYTEKKETLEKGLAKVSAYLVNLKNLRMIDEEPIDYQRNLTGTTKIDEAIQNVEFVIEAIIEEYSAKKNLFNYLDSQLPRDIIIASSTSGLLMTKIQKAMTRYPDRGVIAHPWNPPHLLPLVEIVPGDKTSKYTLDVTKDFMEKLDRVVVVLKKEVPGFIGNRLAFALFREAVNLIDEGVATVEDIDKVMTAAIGLRWAFMGPFLTYHLGGGEGGIEYFFSKGFGYGANEWMYTLAKWDKFPYTAVKKIVDQMKEYEFIKGKNFQDLSRWRDETLVRVYKAVFGEKR

SEQ ID NO: 104 - protein, 322 aa, Sulfolobus islandicus
MFIHMKSINKVAVVGAGIIGVGWTTLLLTKGYKVNLYTEKKETLEKGLAKVSAYLVNLKNLRMINEEPIDYQRNLTGTTKIDEAIQNVEFVIEAIIEDYSAKKNLFNYLDSQLPRDIIIASSTSGLLMTEIQKAMTRYPDRGVIAHPWNPPHLLPLVEIVPGDKTSKYTLDVTKDFMEKLDRVVVVLKKEVPGFIGNRLAFALFREAVNLIDEGVATVEDIDKVMTAAIGLRWAFMGPFLTYHLGGGEGGIEYFFSKGFGYGANEWMYTLAKWDKFPYTAVKKIVDQMKEYEFIKGKNFQDLSRWRDETLVRVYKAVFGEKR

SEQ ID NO: 105 - protein, 324 aa, Sulfolobus solfataricus; identical to SEQ ID NO: 96

SEQ ID NO: 106 - protein, 325 aa, Acidianus hospitalis
MIKRVSVIGAGLIGSGWATLLATKGYEVSLYTDKKETLDKGIAKIKSYLEVMKNMNLVDKEPDYYMKNIRPTLNMDEAIEGTDFVIEAIIEDYDAKKKVFSYLDEKLDKNVILSSSTSGLLMTEIQKAMKRYPERGVIAHPWNPPHLLPLVEIVPGEKTSQETLNVTKDFMEKLDRVVVVLKKEIPGFLGNRLAFALFREAVYLVDEGVATVEDIDKVMTAAIGLRWAFMGPFLTYHLGGGEGGLEYFFSRGFGYGANEWMYTLAKYDKFPYTGVVKAVQQMKEYSFIKGKSFQELSKWRDEKLFQIYKIVWGDKKQNSNGENNK

SEQ ID NO: 107 - protein, 320 aa, Sulfolobus acidocaldarius
MRQVNVVSIVGAGIIGAGWSTLLAVHGYRNIFYTEKKETLDKGILKIKGYLQVMHEYKLADKSPEEYMKLITPTTDFNDVLKGDFIIEAVIEDYGVKKKVFGELDERLDKDVIIASSTSGLLISEIQKSMSRHPERAIIAHPWNPPHLLPLVEIVPGEKTSEEVIQSTREFMEDKLKRVVVVLKKEVPGFIGNRLAFALFREAVHLIDEGVATVEDIDKVVTAAIGLRWVFMGPFLTYHLGGGEGGLEYFFSRGFGYGANEWMYTLAKYDKFPYTGVIKAVNQMKEYQFIKGKSFQELSKWRDENLINVLRFLKEKGAKK

SEQ ID NO: 108 - protein, 322 aa, Sulfolobus islandicus
MFIHMKSINKVAVVGAGIIGVGWTTLLLTKGYKVNLYTEKKETLEKGLAKVSAYLVNLKNLRMIDEEPIDYQRNLTGTTKIDEAIQNVEFVIEAIIEDYSAKKNLFNYLDSQLPRDIIIASSTSGLLMTEIQKAMTRYPDRGVIAHPWNPPHLLPLVEIVPGDKTSKYTLDVTKDFMEKLDRVVVVLKKEVPGFIGNRLAFALFREAVNLIDEGVATVEDIDKVMTAAIGLRWAFMGPFLTYHLGGGEGGIEYFFSKGFGYGANEWMYTLAKWDKFPYTAVKKIVDQMKEYEFIKGKNFQDLSRWRDETLVRVYKAVFGEKR

SEQ ID NO: 109 - protein, 322 aa, Sulfolobus islandicus; identical to SEQ ID NO: 99

SEQ ID NO: 110 - protein, 320 aa, Sulfolobus acidocaldarius; identical to SEQ ID NO: 107

SEQ ID NO: 111 - protein, 318 aa, Sulfolobus tokodaii
MRQIKTVSVIGAGVIGAGWSTLLALKGYENWFYTEKKETLDKGLAKIKGYLNVLYEYKLIDKEPDYYMQRIHPTTKLDEAISNTDFVLEAIVEEYGAKKALFKQLDEKLDKDVILASSTSGLLMTEIQKAMTKYPERGIIAHPWNPPHLLPLVEIVPGEKTSQDTIYATKDFMENKLERVVVVLKKEISGFIGNRLAFALFREAVYLVDEGIATVEDIDKVMTAAIGLRWAFMGPFLTYHLGGGEGGLEYFFSRGFGYGANEWMHTLAKYDKFPYTGVVKSVQQMKEYEFVKSKTFQELSRWRDEKLISLIKLLRGKI

SEQ ID NO: 112 - protein, 169 aa, Sulfolobus islandicus; identical to SEQ ID NO: 45

SEQ ID NO: 113 - protein, 315 aa, Metallosphaera cuprina
MNEKITIVGAGVIGVGWATLFASKGYQVALYTEKNDTLNKGLEKLRNYVQVLRSNNQVTEDPQQILSRVDPTTDLHKAVSNTSFVIEAIIEDYDAKKKLFAHLDQDLPKDVIIASSTSGLLMSEIQKAMKKSPERGVIAHPWNPPHLLPLVEVVPGERTSPEVLEKTKNVMEKLDRVVVVLKKEIPGFIGNRLAFALFREAVNLVDEGVATVEDIDKVMTAAIGLRWAFMGPFLTYHLGGGEGGLEYFFNRGFGYGANEWMHTLAKYEKFPYSGVIKAVQQMKDYAFLKGKTFQDISKWRDEKLLKVYKLVWEQK

SEQ ID NO: 114 - protein, 654 aa, Acidianus hospitalis
MVETQEISEQKLEEKADYNMRYYSYLFKLSKENPAKFWGDLAQELITWFEPWKETMKQEDPLTRWFIGGKLNASYNAVDRHLNSPRKFKAAIIWESERGERRIVTYQDLFYEVNRWANALRELGVKKGDRVTIYMPLTPEGIFAKLACARLGAIHSVVFAGFGSQALADRIDDAKAKVVITADAYYRTGKLVELKKIVDEALDRLGDKSPVSKVLVYRRTGVEIPFKEGRDVYFDEVGKYKYIEPERMDSNDPLFILYTSGTTGKPKGIVHSTGGYLVGTATMLLWSYGLSQENDVLFNTSDIGWIVGHSYITYAPLVMGRTVVIYESAPYYPYPDKWAEIIERYKATTFGTSATALRAFMKYGDDYVKAHDLSSLRVIVTNGEVLNYSPWKWGLEVVGGGKVFMSHQWWQTETGAPNLGYLPGLVYMPMKSGPASGYPLPGNFIEVLDDQGNPTKPRERGYLVMKPPFPPYMMMGMWNDPGNERLKKTYFSKFPGIYYPGDYAMIDEDGYVWVLGRADETIKVAAHRIGAGEVESAITSHPAVAEAAVVGLPDPVKGEEVHAFIVLKEGYTPSDELARNIQNHVREVMGPIVTPKIHFVDKLPKTRSGKVMRRVIKAVMMGSSIGDISTMEDEASMEEIKKAAEEFKKEVSKQ

SEQ ID NO: 115 - protein, 654 aa, Metallosphaera cuprina
MTEEQSLKTGVQELEEKADYNMRYYLHLMKLSKDKPAEFWGSLAEELLDWYEPWKETMKQEDPMTKWFIGGKINASYNAIDRHLNGPRKFKAAVIWESELGERKIVTYQDMFYEVNRWANALRNLGVKRGDRVTIYMPLTPEGIAAMLASARLGAIHSVIFAGFGSQAIADRVEDAKAKVIVTADAYPRRGKTVELKKTVDEALKSLGDRSPVEHVLVYKRLKTDVEMKEGRDFFLDEVGKYKYVEPARMDSTDPLFILYTSGTTGKPKGIVHSTGGYLLGTSVMLLWSYGLSQENDVLFNTSDIGWIVGHSYITYSPLVMGRTVVIYESAPDYPYPDKWAEIIERYRATTFGTSATALRYFMKYGDQYVKEHDLSSVKIIVTNGEVLNYSPWKWGLEVLGGGKVFMSHQWWQTETGAPNLGYLPGLIYMPMKSGPASGFPLPGNFVEVLDDKGDPSKPRTRGYLVMRPPFPPNMMIGMWNDNGERLKKTYFSKFGSLYYPGDFAMIDEDGYVWVLGRADETLKIAAHRIGAGEVESAITSHKAVAEAAVIGVPDPVKGEEVHAFVVLKQGYIASSELAKDIQSHVRKVMGPIVSPQIHFVDKLPKTRSGKVMRRVIKAVMMGSTAGDLTTIEDEASMDEIKKAIDELNKDLKS

SEQ ID NO: 116 - protein, 659 aa, Sulfolobus tokodaii
MTEKLSEQLQQLGEQNLEEKADYNMRYYKYLYKKSIEEPDKFWGELAEELITWYEPWKQAFVQEEGLLTKWFVGGKLNASYNAVDRHLNSHRKYKAAIFWESEKGEKKVVTYQDLFYEVNKWANALRELGVKKGDRVTIYMPLTPEGVIAKLAVARLGAIHSVVFAGFGAQALADRIADAGAKVVITADAYYRRGKLVELKKTVDEALNILGDKSPVQKVLVYKRTGTEIPFKEGRDVYFDEVGKYKYIEPVPVEATEPLFILYTSGTTGKPKGIVHSTGGYLVGTAVMLLWSYGLSQENDVLFNTSDIGWIVGHSYITYSPLVMGRSIVIYESAPDYPYPDKWAEMIEKYRATTFGTSATAIRTLMKYGEDYVKQHDLSSLRIIVTNGEPLNYAPWKWGLEVVGGGKVFMSHQWWQTETGGPNIGYIPGVVYLPMKSGPAVGFALPGNKVTVVNEEGKETKPRERGYLVMLPPFPPMMMIGMWNDPDNERLKKTYFSKFPGIYYPGDYAMIDEDGYIWVMGRADETIKVAAHRIGAGEVESIVTSHPAVAEAAAVGIPDPVKGEAVHLFVVLKVGYKPSPQLAREIQEHVRKYMGAIVTPEVHFVDKLPKTRSGKIMRRVIKAVMMGQSAGDITTLEDEASMDEIKKAVEEFKKSLSQ

SEQ ID NO: 117 - protein, 667 aa, Pyrobaculum islandicum
MHQVLKEELPFNEYVINERWKSRLIDINAYKALHTKSLEQLEEFWASIARELEWFKPWDKVLDASNPPFYKWFVGGKLNLSYLALDRHVKTWRKNKLAIEWEGEPVDENGNPTEQRKLTYFDLYREVNRAAYMLKHNFGIRKGDRITLYMPMIPELPIVMLAAWRIGAVTSVVFSGFSAEALAERINDSQSRIVVTVDGFWRRGKVIRLKEIVDQALEKVGTVENVIVYRRLGLKDVPMTEGRDYWWHKVMEGIKANAYVEPEPLESEHPSFILYTSGTTGKPKGIVHDTGGWAVHVYATMKWVFDLREEDIYWCTADIGWVTGHSYVVLGPLMIGATQVIYEGAPDYPQPDRWWAIIERYGVTILYTSPTAIRMFMRYGEEWPRRHDLSTLRIIHSVGEPINPEAWRWAYKVLGNENVAMASTWWMTETGGIVISHTPGLYLIPMKPGTNGLPLPGFDVDVFDDNGKPAPPGVRGYLVIKRPWPGMLHGIWGDPDRYIKTYWSKFPGVFYAGDYAIKDQDGYIWVLGRADEVIKVAGHRLGTYELESALVSHPTVAEAAVVGVPDPIKGEVPIAFVVLKQGVMPSDELRKELRDHVRKTIGPVAEPAHIFFVTKLPKTRSGKIMRRLLKAVATGAPLGDTTTLEDETSVEEAKKAYEELRREIARG

SEQ ID NO: 118 - protein, 655 aa, Metallosphaera yellowstonensis
MTEEQPLKMGQQELEEKADYNMRYFKHLFTLSKEKPSEFWGSLAQDLLDWYEPWKETMRQENPMTKWFLEGKINASYNAVDRHLNTSRKFKAAVVWESELGERKIVTYQDMFYEVNRWANALLELGVRRGDRVTIYMPLIPEGVAAMLACARIGAIHSVVFAGFGSQAIADRVEDAQAKVIVTADAYPRRGRVVELKKTVDEALKSLGERSPVKKVLVYRRMKTEVDMKEGRDVYFDEVGKYRYVEPERMDSNDPLFILYTSGTTGKPKGIVHSTGGFLTGTSLMLLWSYGLSQENDVLFNTSDIGWIVGHSYITYSPLVMGRTVVIYESAPDYPYPDKWAEIIERYRATTFGTSATALRYFMKYGDEYVKTHDLSSLRIIVTNGEVLNYSPWKWGLEVLGGGKVYMSHQWWQTETGAPNLGYIPGVVYLPMKSGPASGFPLPGNFVEVLDDSGNPAKPRERGYLVMRPPFPPNMMIGMWNDTGERLKKTYFSKFGSLYYPGDYAMVDEDGYVWVLGRADETIKIAAHRIGAGEVESAITSFPAVAEAAVIGVPDPVKGEEVHAFVVLKKGYSPSHELGKEIQAHVRKVMGPIVSPQVHFVEKLPKTRSGKVMRRVIKAVMTGANLGDLTTIEDEASMEDIKRAVEELKRELRGA

SEQ ID NO: 119 - protein, 638 aa, Thermofilum pendens
MGVLPVEERRVLTAKLDEMRRKALEDPESFWDEHARALEWYKIWDKVLDDGEKPFYRWFVGGRINASYNALDRHVKTWRKNKVALIWEGEDGSVKKYSYRDLYVEVNRVAALLKNFGVKKGDRVALYLPMIPELPIFMLAAARIGAPFTVIFSGFSSDSLAKRLNDSGAKLLVTADGFWRRGRVVRLKDIADKSLEQALSVESVLVVRHAGVDVAMQEGRDYWYHEALEGIGRNTYVEPERLDSNHPLFILYTSGTTGTPKGIYHSTGGYLVWVYWTLKWAFNPNDEDIWWCTADIGWITGHSYVVFGPLLHGLTTLMYEGAPDYPAPDRWWSIIERHGVTVFYTSPTAIRMFMRYGSHWVEKHDLSSLRILGSVGEPINPEAWEWYFKVVGKGRCPIIDTWWQTETGGFMISPAAGIELVPLKPGSATLPLPGVDADVVDDNGNPAKPGVQGYLVIKRPWPGMLLGVWGDPERYVKTYWGRFDGYYFPGDYAMKDEDGYFWILGRADEVLKVAAHRIGTMELESALVEHPAVSEAAVVGKPDPVKGEVPVAFVVLKEGFSPSVKLEEELSNHVAEVIGPIARPAAIIFVKKLPKTRSGKIMRRVLKALVRGEASLGDLSTIEDPSAVDEVKAALRIA

SEQ ID NO: 120 - protein, 646 aa, Acidianus hospitalis
MSENLPFEERYYQPPYKQLYKQSLEEPEKFWREMAEGLEWFSPFDKVLDESNAPFYRWFVGGKINITYNALDRQVKVRRNKIAIYWENEKGESRQLTYGELYNEVNRFAKILQDLGIKKGDRVLIYLPLMPELPIAMLACARIGAVHSVVFSGFSTQAVIDRINDAKAKLVITTSHTMRRGKRVELKRIIDEAVSQTPSVEKVLVIKRDEEIELNEERDVLYQDLIKRTGYKKVEPEETLSTDPLFILYTSGTTGKPKGILHLHGGYGLWTYLTTQWVFDLRDTDVFFNTADIGWITGHSYIVYGPLQNGASVLMYEGVPDYPNPDRWWELVEKYGVTVFYTSPTAIRSLMKYGEEWVKKHDLSTLRILGSVGEPINPEAWRWYFKNVGNSSLPIVDTWWQTETGGIMISATPGLGNYLLKPSANGLPLPGVDADVFTEDGKQAKPREKGYIVIKRPWPGMLAGVWGDPERYVKTYFSKFPGVYYPGDYAVRDEEGFFYILGRADEVLKIAGHRIGTREIEDILISHPAVAESAVIGVPDPVRGEVAVAAIVLKQGYQPSEELRKSLIEYVKNNLGPIVIFGGLYFVSKLPKTRSGKIMRRVVRSVISGQPLGDVSTLEDETSVDELKKVIEEFTKEIQGQQNEKK

SEQ ID NO: 121 - protein, 656 aa, Pyrolobus fumarii
MTSEPKTLPTEARFIPKRLEEVRKRALENPEEFFAEIARELEWFKTWDKVLDDSNPPFYRWFVGGLINASYNAVDRHLKRGLRNKAAIIWEGEPGDTRVLTYYQLYREVNRFAAVLENLGLRKGDTIAFYLPMIPELPIFMLAAARLGITFTVVFSGFSAKALAERINDAKAKVLVTADGGFRRGKVIELKKIADEALEMAPSVETVIVVKNVTARGAKIDVPLTEGRDYWLHNLLPAHAKVDPVPVESTHPLFILYTSGTTGKPKGVVHSTGGYLVWVYATMKWVFDVKPDDVMFCTADIGWITGHSYVVFGPLLHGITTVMYEGAPDYPAPDRWWQIVEKYGVTIFYTAPTAIRMLMRYGEEWVKKHDLSTLRILGTVGEPINPEAWKWYYTVVGGERCPIVDTWWQTETGGIMISPAPGIQLVPLKPGSATYPLPGVDADVVCEDGSPCPPGQRGYLVIKRPWPGMLMTLWGDPERYVRTYWQRFSKPEEGKWIYYPADYAMKDEDGYFWILGRADEVIKVAGHRLGTAEIESALVSHPAVAEAAVVGKPDPVKGEVPVAFVVLRQGYTPSEELRHELVEHVRKTLGPIAVPAAIFFVEKLPKTRSGKIMRRVIKAVLLGKTPGDLTTLEDEASLDEIRRALEEFKRELEKAE

SEQ ID NO: 122 - protein, 652 aa, Sulfolobus solfataricus
MVQEITENIKEIEEKVDYNTRIYREIYRESIENPGKFWGKLGEDLIDWFEPWKEIYKQETLTKWFLGGKLNASYNAIDRHLNSSRKFKAAIIWESEKGERKILTYQDLFYEVNRWANALKQLGVKKGDRVTIYMPLTPEGVTAMLACARIGAIHSVVFAGFGSQALADRIADAQSKIVITADGYYRKGRLIELKKTVDDALSKLQDNSVKNIIIFRRIGIEIPFKEGRDVFFDEIGKYKYIEPEPVEATHPLFILYTSGTTGKPKGIVHSTGGYLVGTATMLLWSYGLSQENDVLFNTSDIGWIVGHSYITYSPLVMGRSVVIYESAPDYPTPDKWAELIEKYKATTFGTSATFLRYLMKYGEDYIKAHDLSSLRIIVTNGEPLNYAPWKYGLEIIGKGRVFMSHQWWQTETGAPNLGYMPGYPIFLTMKSGPASGFPLPGNKIKVVDENGNPTRPRERGYLIIEPPFPPMMMIGMWNDDGNERVIKTYFSKFPNLYYTGDFAMIDEDGYVWVSGRADETLKIAGHRIGAGEVESAITSHPAVAEAAVIGIPDPVKGEIAHAFVVLKQGYHQNNELSKEIQEHVRKIMGPIVLLEVHFVNALPKTRSGKVMRRVIKAVMTGSNIGDISTLEDEASMEEIKKAIEVLRRQLNP

SEQ ID NO: 123 - protein, 652 aa, Sulfolobus solfataricus; identical to SEQ ID NO: 122

SEQ ID NO: 124 - protein, 654 aa, Sulfolobus acidocaldarius
MAEKPIDELQQLEEKADYNLRIYKNIYKQSIEEPSKFWDRIAESLIDWFEPWKKTFVQEEGLLTKWFVEGKLNASYNAIDRHAFSNRKFKAAIIWESGKHERRVLTYQDLYYEVNRWANALREIGVRKGDRVTIYMPLTPEGVISMLAVTRLGAIHNVVFAGFGVQALADRISDAGSKVVITADAYYRRGKLVELKKAVDESIRLLGKNSPVEKVIIYKRTGSEIPFDDKRDVYFEEIAKYKPIDPEPVESTHPLYILYTSGTTGKPKGIVHSTAGYLVGTSIMLLWSYGMSEENDILFNTSDIGWVVGHSYITYAPLVMGRSIVIYEDAPDYPYADKWAEIIERNRVTVFGTSATALRSFMKYGDEVVKKHDLSSLRVIVTAGEPLNYAPWKWGLEVVGNGRVYMSHQWWQTETGSPNLGYMPGLIYLPMKSGPTCGFPLPGNKIEILDESGNTTKPRNRGYLVMLPPYPPSMMIGMWNDPGNERLKKSYFSKFPGIYYSGDYAMIDEEGYIWVMGRADETIKVAAHRIGAGEVESITTSHPAVAEAAAIGLPDPVKGENIHIFVVLKTGHVPSQELATEIQAYMRGHMGAIVTPEIHFVEKLPKTRSGKVMRRVIKAVMLGQSTGDISTIEDETSMEEIKRAIEEFKQSLKT

SEQ ID NO: 125 - protein, 670 aa, Pyrobaculum aerophilum [sequence omitted]

SEQ ID NO: 126 - protein, 654 aa, Sulfolobus acidocaldarius; identical to SEQ ID NO: 124

SEQ ID NO: 127 - protein, 652 aa, Sulfolobus islandicus
MEQEITENIKEIEEKVDYNIRLYKEIYRESIENPSKFWSKLAEELIDWFEPWKETFTQEILTKWFVGGKLNASYNAIDRHLNSSKKFKAAIIWESEKGERKVLIYQDLFYEVNRWANALKQLGVQKGDRVTIYMPLTPEGVISMLACARIGAIHSVVFAGFGSQALADRIADAQSKVVITADGYYRKGRLVELKKTVDEALSKLQNNPVKNVIVFRRSGTETPFKEGRDIYFDEIGKYRYVEPEPVDASHPLFILYTSGTTGKPKGIVHSTGGYLVGTAAMLLWSYGLSQENDVLFNTSDIGWIVGHSYITYSPLVMGRSVIIYESIPDYPYPDKWAELIEKYKATTFGTSATFLRYLMKYGEEYIKAHDLSSLRIMVTNGEPLNYAPWKYGLEVIGKGKVFMSHQWWQTETGAPNLGYMPGYPIFLTMKSGPASGFPLPGNKIKVVDENGNLVKPRERGYLIMEPPFPPSMMIGMWNDEDNERIIKTYFSKFPNVYYTGDFAMIDEDGYVWVSGRADETLKIAGHRIGAGEVESAITSHPAVAEAAVIGIPDPVKGETAHAFVVLKQGYHPGNELAKSINEHVKKVMGPIVILEVHFVNALPKTRSGKVMRRVIKAVMMGSTVGDISTLEDEASMEEIKKAIEALRSQLNP

SEQ ID NO: 128 - protein, 652 aa, Sulfolobus islandicus
MEQEITENIKEIEEKVDYNIRLYKEIYRESIENPSKFWSKLAEELIDWFEPWKETFTQEILTKWFVGGKLNASYNAIDRHLNSSKKFKAAIIWESEKGERKVLIYQDLFYEVNRWANALKQLGVQKGDRVTIYMPLTPEGVISMLACARIGAIHSVVFAGFGSQALADRIADAQSKVVITADGYYRKGRLVELKKTVDGALSKLQNNPVKNVIVFRRSGTETPFKEGRDIYFDEIGKYRYVEPEPVDASHPLFILYTSGTTGKPKGIVHSTGGYLVGTAAMLLWSYGLSQENDVLFNTSDIGWIVGHSYITYSPLVMGRSVIIYESVPDYPYPDKWAELIEKYKATTFGTSATFLRYLMKYGEEYIKAHDLSSLRIMVTNGEPLNYAPWKYGLEVIGKGKVFMSHQWWQTETGAPNLGYMPGYPIFLTMKSGPASGFPLPGNKIKVVDENGNLVKPRERGYLIMEPPFPPSMMIGMWNDKDNERIIKTYFSKFPNVYYTGDFAMIDEDGYVWVSGRADETLKIAGHRIGAGEVESAITSHPAVAEAAVIGIPDPVKGETAHAFVVLKQGYHPGNELAKSINEHVKKVMGPIVILEVHFVNALPKTRSGKVMRRVIKAVMMGSAVGDISTLEDEASMEEIKKAIEALRSQLNP

SEQ ID NO: 129 - protein, 652 aa, Sulfolobus islandicus
MEQEITENIKEIEEKVDYNIRLYKEIYRESIENPSKFWSKLAEELIDWFEPWKETFTQEILTKWFVGGKLNASYNAIDRHLNSSKKFKAAIIWESEKGERKVLIYQDLFYEVNRWANALKQLGVQKGDRVTIYMPLTPEGVISMLACARIGAIHSVVFAGFGSQALADRIADAQSKVVITADGYYRKDRLVELKKTVDEALSKLQNNPVKNVIVFRRSGTETPFKEGRDIYFDEIGKYRYVEPEPVDASHPLFILYTSGTTGKPKGIVHSTGGYLVGTAAMLLWSYGLSQENDVLFNTSDIGWIVGHSYITYSPLVMGRSVIIYESVPDYPYPDKWAELIEKYKATTFGTSATFLRYLMKYGEEYIKAHDLSSLRIMVTNGEPLNYAPWKYGLEVIGKGKVFMSHQWWQTETGAPNLGYMPGYPIFLTMKSGPASGFPLPGNKIKVVDENGNLVKPRERGYLIMEPPFPPSMMIGMWNDEDNERIIKTYFSKFPNVYYTGDFAMIDEDGYVWVSGRADETLKIAGHRIGAGEVESAITSHPAVAEAAVIGIPDPVKGETAHAFVVLKQGYHPGNELAKSINEHVKKVMGPIVILEVHFVNALPKTRSGKVMRRVIKAVMMGSTVGDISTLEDEASMEEIKKAIEALRSQLNP

SEQ ID NO: 130 - protein, 652 aa, Sulfolobus islandicus
MEQEITENIKEIEEKVDYNIRLYKEIYRESIENPSKFWSKLAEELIDWFEPWKETFMQEILTKWFVGGKLNASYNAIDRHLNSSKKFKAAIIWESEKGERKVLIYQDLFYEVNRWANALKQLGVQKGDRVTIYMPLTPEGVISMLACARIGAIHSVVFAGFGSQALADRIADAQSKVVITADGYYRKGRLVELKKTVDEALSKLQNNPVKNVIVFRRSGIETPFKEGRDIYFDEIGKYRYVEPEPVDASHPLFILYTSGTTGKPKGIVHSTGGYLVGTAAMLLWSYGLSQENDVLFNTSDIGWIVGHSYITYSPLVMGRSVIIYESVPDYPYPDKWAELIEKYKATTFGTSATFLRYLMKYGEEYIKAHDLSSLRIMVTNGEPLNYAPWKYGLEVIGKGKVFMSHQWWQTETGAPNLGYMPGYPIFLTMKSGPASGFPLPGNKIKVVDENGNLVKPRERGYLIMEPPFPPSMMIGMWNDEDNERIIKTYFSKFPNVYYTGDFAMIDEDGYVWVSGRADETLKIAGHRIGAGEVESAITSHPAVAEAAVIGIPDPVKGETAHAFVVLKQGYHPGNELAKSINEHVKKVMGPIVILEVHFVNALPKTRSGKVMRRVIKAVMMGSAVGDISTLEDEASMEEIKKAIEALRSQLNP

SEQ ID NO: 131 - protein, 652 aa, Sulfolobus islandicus
MEQEITENIKEIEEKVDYNIRLYKEIYRESIENPSKFWSKLAEELIDWFEPWKETFTQEILTKWFVGGKLNASYNAIDRHLNSSKKFKAAIIWESEKGERKVLIYQDLFYEVNRWANALKQLGVQKGDRVTIYMPLTPEGVISMLACARIGAIHSVVFAGFGSQALADRIADAQSKVVITADGYYRKGRLVELKKTVDGALSKLQNNPVKNVIVFRRSGTETPFKEGRDIYFDEIGKYRYVEPEPVDASHPLFILYTSGTTGKPKGIVHSTGGYLVGTAAMLLWSYGLSQENDVLFNTSDIGWIVGHSYITYSPLVMGRSVIIYESVPDYPYPDKWAELIEKYKATTFGTSATFLRYLMKYGEEYIKAHDLSSLRIMVTNGEPLNYAPWKYGLEVIGKGKVFMSHQWWQTETGAPNLGYMPGYPIFLTMKSGPASGFPLPGNKIKVVDENGNLVKPRERGYLIMEPPFPPSMMIGMWNDEDNERIIKTYFSKFPNVYYTGDFAMIDEDGYVWVSGRADETLKIAGHRIGAGEVESAITSHPAVAEAAVIGIPDPVKGETAHAFVVLKQGYHPGNELAKSINEHVKKVMGPIVILEVHFVNALPKTRSGKVMRRVIKAVMMGSAVGDISTLEDEASMEEIKKAIEALRSQLNP

SEQ ID NO: 132 - protein, 652 aa, Sulfolobus solfataricus; identical to SEQ ID NO: 122

SEQ ID NO: 133 - protein, 652 aa, Sulfolobus islandicus; identical to SEQ ID NO: 131

SEQ ID NO: 134 - protein, 652 aa, Sulfolobus islandicus
MEQEITENIKEIEEKVDYNIRLYKEIYRESIENPSKFWSKLAEELIDWFEPWKETFMQEILTKWFVGGKLNASYNAIDRHLNSSKKFKAAIIWESEKGERKVLIYQDLFYEVNRWANALKQLGVQKGDRVTIYMPLTPEGVISMLACARIGAIHSVVFAGFGSQALADRIADAQSKVVITADGYYRKGRLVELKKTVDEALSKLQNNPVKNVIVFRRSGIETPFKEGRDIYFDEIGKYRYVEPEPVDASHPLFILYTSGTTGKPKGIVHSTGGYLVGTAAMLLWSYGLSQENDVLFNTSDIGWIVGHSYITYSPLVMGRSVIIYESVPDYPYPDKWAELIEKYKATTFGTSATFLRYLMKYGEEYIKAHELSSLRIMVTNGEPLNYAPWKYGLEVIGKGKVFMSHQWWQTETGAPNLGYMPGYPIFLTMKSGPASGFPLPGNKIKVVDENGNLVKPRERGYLIMEPPFPPSMMIGMWNDEDNERIIKTYFSKFPNVYYTGDFAMIDEDGYVWVSGRADETLKIAGHRIGAGEVESAITSHPAVAEAAVIGIPDPVKGETAHAFVVLKQGYHPGNELAKSINEHVKKVMGPIVILEVHFVNALPKTRSGKVMRRVIKAVMMGSAVGDISTLEDEASMEEIKKAIEALRSQLNP

SEQ ID NO: 135 - protein, 652 aa, Sulfolobus islandicus; identical to SEQ ID NO: 134

SEQ ID NO: 136 - protein, 652 aa, Sulfolobus islandicus; identical to SEQ ID NO: 131

SEQ ID NO: 137 - skipped

SEQ ID NO: 138 - protein, 257 aa, Sulfolobus tokodaii
METIVIKKETPIGWIYLNRPDRLNAINQQMIKELRQGIDEMVYDSDIKVIIITGNGKAFSAGADISRFKELNGYTAWQFAKSGRELMDYIENISKPTIAMVNGYALGGGLELAMACDIRIAAEEAQLGLPEINLGIYPGFGGTQRLVRLIGKGKALELMLTGDRISAKEAEKIGLVNKVVPLSNLEQETRNFALKLAEKPPISIALIKLLVNQGIDLPILAGLNMESLGWGVVFSTEDEKEGVSAFLEKRKAQFKGK

SEQ ID NO: 139 - protein, 257 aa, Acidianus hospitalis
METVETKIENGIGWIILNRPDKLNAINLKMLEELEEVTKNFEENNDVKIIIFTGNGKAFSAGADISQFKELNSISAWNFAKKGRRVMDYIESVSKPTIAMINGYALGGGLELALACDFRIAAEEASLGLPEINLGIYPGFGGTQRLVRAIGKAKAMELMMTGDRISAKEAERIGLVNKVVSLSSLKEETIKFAGKLMEKSPIALAILKHIILYGNDSPLLDGLNMESLGWGVAFSTEDEKEGVSAFLEKRKAVFKGK

SEQ ID NO: 140 - protein, 257 aa, Sulfolobus acidocaldarius
METIIVKNEPPFLRITLNRPDRLNAINKKMIEEIRTVLEETVKDEKVRVIIFTGNGRAFSAGADISQFKELEGLTAWQFAMKGRELMDYIENYPKPTIAMINGYALGGGLELALACDIRIASDEAQLGLPEITLGIYPGFGGTQRLLKLVGKSRTLEMIMLGERISAKDAERIGLVNRVVPSNDLEKETLNLASKLAERPPLAIQLSKLIVNQGMNSPITVGLNMESLGWGVIFTTKDSKEGVNAFLEKRKPNFKGE

SEQ ID NO: 141 - protein, 264 aa, Sulfolobus acidocaldarius
MEVIVFFMETIIVKNEPPFLRITLNRPDRLNAINKKMIEEIRTVLEETVKDEKVRVIIFTGNGRAFSAGADISQFKELEGLTAWQFAMKGRELMDYIENYPKPTIAMINGYALGGGLELALACDIRIASDEAQLGLPEITLGIYPGFGGTQRLLKLVGKSRTLEMIMLGERISAKDAERIGLVNRVVPSNDLEKETLNLASKLAERPPLAIQLSKLIVNQGMNSPITVGLNMESLGWGVIFTTKDSKEGVNAFLEKRKPNFKGE

SEQ ID NO: 142 - protein, 259 aa, Metallosphaera cuprina
MEYETLETKKEGNLFWITLNRPDKLNALNSKLLEELNRAVSEGESDPEVRVIIITGKGKAFCAGADITQFNQLSPTDAWRFSKRGREVMDKIESLSKPTIAMINGYALGGGLELALSCDIRIAAEEAQLGLPEINLGIYPGYGGTQRLTRIVGKGRALEIMMTGDRLSGKDAERYGLVNRVTPLSNLEQETRKLAEKIARKSPVSLALIKEVVNKGLDSPLASGLSLESIGWGVIFSTEDKKEGVNAFLEKREPNFKGK

SEQ ID NO: 143 - protein, 252 aa, Sulfolobus solfataricus
METIVTKEEPPIEWIVLNRPDKLNSINSIMIREIGDILRQIVDNDKIKVVIFTGSGKAFSAGADISQFKDLDPVKAWEFAIKGRELMDYIERYPKPTIAMINGYALGGGLELALSCDLRIASQIAELGLPEINLGIYPGFGGTQRLVRLIGKGRAMEIIMLGDIIKADYAERIGLVNRVVEPSSLEKEVRELALKLAEKPQIAIRLIKTVVNYGNDAPILSGLTLESLGWGIAFATEEEKKRVNEFLSRRSK

SEQ ID NO: 144 - protein, 252 aa, Sulfolobus solfataricus; identical to SEQ ID NO: 143

SEQ ID NO: 145 - protein, 259 aa, Metallosphaera yellowstonensis
MEFETLELKKEGHLAWIILNRPERLNSINGKLLEELQRALTELEADRKVKVLLITGKGKAFCAGADITQFTELNPTEAWKFAKMGREVMTRIENLMKPVIAVINGYALGGGLELALACDIRIASEEAQLGLPEINLGIFPGFGGTQRLTKLVGKGRAVEIMMTGDRIGAKDAEKMGLVNRVVPGSALQEEATKLAEKIAKKSAVALALIKEVVNRGVDAPLQSGLAMESIGWGVAFSTEDKQEGVKAFLEKREPNFKDR

SEQ ID NO: 146 - protein, 252 aa, Sulfolobus islandicus
METIIVREEPPIEWIILNRPDKLNSINVKMVEEIGSALRQNINNDKIKVIIFTGSGKAFSAGADISQFKELDPVKAWEFATKGRELMDYIERYPKPTIAMINGYALGGGLELALSCDLRIASQNAELGLPEINLGIYPGFGGTQRLVRLIGKGRALEIIMLGDRIKADYAERIGLVNRVVESSSLEKEVRELALKLAEKPQTAIRLIKTVVNYGNDGPILSGLTLESLGWGIAFATEEEKKRVDEFLSKRSK

SEQ ID NO: 147 - protein, 252 aa, Sulfolobus islandicus
METIIVREEPPVEWIILNRPDKLNSINVKMVEEIGSALRQNINNDKIKVIIFTGSGKAFSAGADISQFKELDPVKAWEFATKGRELMDYIERYPKPTIAMINGYALGGGLELALSCDLRIASQNAELGLPEINLGIYPGFGGTQRLVRLIGKGRALEIIMLGDRIKADYAERIGLVNRVVESSSLEKEVRELALKLAEKPQTAIRLIKTVVNYGNDGPILSGLTLESLGWGIAFATEEEKKRVDEFLSKRSK

SEQ ID NO: 148 - protein, 252 aa, Sulfolobus islandicus
METIIVREEPPVEWIILNRPDKLNSINVKMVEEIGSALRQNINNDKIKVIIFTGSGKAFSAGADISQFKELDPVKAWEFATKGRELMDYIERYPKPTIAMINGYALGGGLELALSCDLRIASQNAELGLPEINLGIYPGFGGTQRLVRLIGKGRALEIIMLGDRIKADYAERIGLVNRVVESSSLEKEVRELALKLAEKPQTAIRLIKTVVNYGNDGPILSGLTLESLGWGIAFATEEEKKRVNEFLSKRSK

SEQ ID NO: 149 - protein, 252 aa, Sulfolobus islandicus; identical to SEQ ID NO: 146

SEQ ID NO: 150 - protein, 252 aa, Sulfolobus islandicus; identical to SEQ ID NO: 147

SEQ ID NO: 151 - protein, 252 aa, Sulfolobus islandicus; identical to SEQ ID NO: 147

SEQ ID NO: 152 - protein, 252 aa, Sulfolobus solfataricus; identical to SEQ ID NO: 143

SEQ ID NO: 153 - protein, 252 aa, Sulfolobus islandicus; identical to SEQ ID NO: 146

SEQ ID NO: 154 - protein, 252 aa, Sulfolobus islandicus; identical to SEQ ID NO: 146

SEQ ID NO: 155 - protein, 252 aa, Sulfolobus islandicus; identical to SEQ ID NO: 146

SEQ ID NO: 156 - protein, 334 aa, Sulfolobus tokodaii
MKAIVVPGPKQGYKLEEVPDPKPGKDEVIIRVDRAALCYRDLLQLQGYYPRMKYPVILGHEVVGTIEEVGENIKGFEVGDKVISLLYAPDGTCEYCQIGEEAYCHHRLGYSEELDGFFAEKAKIKVTSLVKVPKGTPDEGAVLVPCVTGMIYRGIRRAGGIRKGELVLVTGASGGVGIHAIQVAKALGAKVIGVTTSEEKAKIIKQYADYVIVGTKFSEEAKKIGDVTLVIDTVGTPTFDESLKSLWMGGRIVQIGNVDPSQIYNLRLGYIILKDLKIVGHASATKKDAEDTLKLTQEGKIKPVIAGTVSLENIDEGYKMIKDKNKVGKVLVKP

SEQ ID NO: 157 - protein, 332 aa, Metallosphaera cuprina
MKAVIVKGAKQGYEVRDVQDPKPQPDEVVIKVNRAALCYRDLLQLQGFYPRMKYPVVLGHEVIGEIVDVGRDVKGFAIGDRVISLLYAPDGSCHYCKRGEEAYCHSRLGYSEELDGFFAEMARVKVSSLVKVPPGVSDEGGVMVPCVTGMIYRGLRRANLSEGETVLVTGASGGVGIHALQVAKGMGARVIGVTTSEEKSSIIAKYSDRVIVGSKFSEEAKKEDVNVIIDTVGTPTFEESLRSLWMGGRIVQIGNVDPTQAYQLRLGYTILKDIAIIGHASATKRDAEAALKLTSEGKVRPIVAGTVSLEEIDKGYEILKDKHKVGKVLLKP

SEQ ID NO: 158 - protein, 334 aa, Sulfolobus acidocaldarius
MKAIVVPAPKQNYSLQEVKDPKPNSDEVVIRVVRAGLCYRDLLQLQGYYPRMKYPVVLGHEVVGEIEEVGDNVSGFKIGDRVISLLYAPDGSCEYCKVGEEAYCKRRLGYSEELDGFFAERAKVKVTSIVKVPQSVSDDAAVIVPCVTGMIYRGIRRAGGINKNEYALVTGASGGVGIHAIQVAKALGARTIGVTTSEDKAKVIRKYADHVIVGSKFSDEARKIGDISLVIDTVGTPTIEESLRSLRMGGKLVQIGNVDPSQIYSLRLGYLILKDILLVGHASATKYDAEQTLKLTEGGNISAVVAGHVNLDNIDEGYRMIKDRNKIGKVLLKP

SEQ ID NO: 159 - protein, 333 aa, Sulfolobus solfataricus
MKAVVVPGKQKGYRIEEVSDPIPGKDEVVIRVNRAALCYRDLLQLQGFYPRMKYPVILGHEVVGTIEQIGENAKGFKEGDKVISLLYAPDGTCHYCQMGEEAYCHSRVGYSEELDGFFAEKAKVKVTSIVKVGTNVPDEGAVLVPCVTGMVYRSLRRAKLQKGETVLVTGASGGVGIHAIQVAKALGAKVIGVTTSEEKAAFIRKFADHVIVGSKFSEEAKKIGDVNVVIDTVGTPTIDESLKSLWMGGRLVQIGNVDPTQIYQLRLGYVILKDIAIIGHASATKRDAEETLKLTGEGKINPVIAATVGLDEIDKGYEILKDKHKIGKVLVKP

SEQ ID NO: 160 - protein, 333 aa, Sulfolobus islandicus
MKAVVVQGKQKGYRIEEVPDPIPGKDEVVIRVNRAALCYRDLLQLQGFYPRMKYPVILGHEVVGTIEQVGENVKGFKEGDKVISLLYAPDGTCHYCQMGEEAYCHSRLGYSEELDGFFAEKAKIKVTSLVKVGTNVPDEGAVLVPCVTGMVYRSLRRAKLQKGETVLVTGASGGVGIHAIQIAKALGAKVIGVTTSEEKAAFIRKFADHIIVGSKFSEEAKKIGDVNVVIDTVGTPTIDESLKSLWMGGRLIQIGNVDPTQIYQLRLGYVILKDIEVIGHASATKRDAEETLKLTGEGKINPVVAATVGLDEIDKGYEILKDKHKIGKVLVKP

SEQ ID NO: 161 - protein, 333 aa, Sulfolobus islandicus; identical to SEQ ID NO: 160

SEQ ID NO: 162 - protein, 336 aa, Sulfolobus islandicus
MKAVILPAHKQGYRIEEVPDPKPGKDEAIIKVNKAALCYRDLLQIKGFYPRSKYPLILGHEVVGTVEEVGEDVNNFKKGDRVTSMLFVPDWSCEYCKSGEEVYCKNRVVYAQELDGFFAEKAKVKASSLVKVPESVSDEGAVIVPCVAAMVYRGLKKAGIKKGEIVLVTGASGGVGIHAIQVAKALGAKVIGVTSGESKAKIVSKYADYVIVGEKFSEEAKKIGDVSIVIENVGPYTLEESMKSLRSGGKIIQIGNLDPSVTFNLRLGYIILKDISLMGHIGANKKDIIETLNLVKEGKIKPVIGSEVSLENFGKALDLLNDSKNRYGKILISNSF

SEQ ID NO: 163 - protein, 333 aa, Sulfolobus islandicus; identical to SEQ ID NO: 160

SEQ ID NO: 164 - protein, 333 aa, Sulfolobus islandicus
MKAVVVQGKQKGYRIEEVPDPIPGKDEVVIRVNRASLCYRDLLQLQGFYPRMKYPVILGHEVVGTIEQVGENVKGFKEGDKVISLLYAPDGTCHYCQMGEEAYCHSRLGYSEELDGFFAEKAKIKVTSLVKVGTNVPDEGAVLVPCVTGMVYRSLRRAKLQKGETVLVTGASGGVGIHAIQIAKALGAKVIGVTTSEEKAAFIRKFADHIIVGSKFSEEAKKIGDVNVVIDTVGTPTIDESLKSLWMGGRLIQIGNVDPTQIYQLRLGYVILKDIEVIGHASATKRDAEETLKLTGEGKINPVVAATVGLDEIDKGYEILKDKHKIGKVLVKP

SEQ ID NO: 165 - protein, 333 aa, Sulfolobus islandicus; identical to SEQ ID NO: 160

SEQ ID NO: 166 - protein, 336 aa, Sulfolobus islandicus
MKAVILPAHKQGYRIEEVPDPKPGKDEAIIKVNKAALCYRDLLQIKGFYPRSKYPLILGHEVVGTVEEVGEDVNNFKKGDRVTSMLFVPDWSCEYCKSGEEVYCKNRVVYAQELDGFFAEKAKVKASSLVKVPESVSDEGAVIVPCVAAMVYRGLKKAGIKKGEIVLVTGASGGVGIHAIQVAKALGAKVIGVTSGESKAKIVSKYADYVIVGEKFSEEAKKIGDVSIVIENVGPYTLEESMKSLRSGGKIIQIGNLDPSVTFNLRLGYIILKDISLMGHIGANKNDIIKTLNLVKEGKIKPVIGSEVSLENFGKALDLLNDSKNRYGKILISNSF

SEQ ID NO: 167 - protein, 336 aa, Sulfolobus solfataricus
MKAVVLPAHNQGYRIEEIADPKPYKGEVVIKVNKAALCYRDLLQIKGFYPRSKYPLILGHEVVGTVEEVGENVNDYREGDRVTSMLFVPDWSCEYCKSGEEVYCKNRVLYAQELDGFFAEKARVKASSLVKIPENVSDEGAVIVPCVAAMVYRGLKKAGIKEGENVLVTGASGGVGIHAIQVAKALGAKVIGVTSSESKARIVSKFADYVIVGDKFSEEAKKIGDISIVIENVGPYTLEESMRSLRSGGKIIQIGNLDPSITFNLRLGYVILKDLSLIGHIGANKKDIVETLNLVKEGKIKPVIGSEFRLEDFGKALDLLKENKNRYGKILISNSF

SEQ ID NO: 168 - protein, 333 aa, Sulfolobus islandicus; identical to SEQ ID NO: 160

SEQ ID NO: 169 - protein, 333 aa, Sulfolobus islandicus
MKAVVVQGKQKGYRIEEVPDPIPGKDEVVIRVNRAALCYRDLLQLQGFYPRMKYPVILGHEVVGTIEQVGENVKGFKEGDKVISLLYAPDGTCHYCQMGEEAYCHSRLGYSEELDGFFAEKAKIKVTSLVKVGTNVPDEGAVLVPCVTGMVYRSLRRAKLQKGETVLVTGASGGVGIHAIQIAKALGAKVIGVTTSEEKAAFIRKFVDHIIVGSKFSEEAKKIGDVNVVIDTVGTPTIDESLKSLWMGGRLIQIGNVDPTQIYQLRLGYVILKDIEVIGHASATKRDAEETLKLTGEGKINPVVAATVGLDEIDKGYEILKDKHKIGKVLVKP

SEQ ID NO: 170 - protein, 333 aa, Sulfolobus islandicus; identical to SEQ ID NO: 160

SEQ ID NO: 171 - protein, 333 aa, Sulfolobus solfataricus; identical to SEQ ID NO: 159

SEQ ID NO: 172 - protein, 333 aa, Sulfolobus islandicus; identical to SEQ ID NO: 160

SEQ ID NO: 173 - protein, 337 aa, Acidianus hospitalis
MFKLMKAVVVIGHKQGYKVQEVPDPKPADDEVIIKVDRAALCYRDLLQLQGYYPRMKYPVILGHEVVGTIIQKGKKVEGFEEGDKVVSLLYAPDGTCEYCKQGEEAYCHSRLGYSEELDGFFAEYAKIKVTSLVKVPKGTPDEGAVLVPCVTGMIYRGLMRAHLKPGETVLVTGASGGVGIHAVQVAKALGAKVIGVTTSEEKAPFIKKFADHVIVGKKFAEEAKKISDVHVVIDTVGTPTFDESLKSLWMGGRIVQIGNVDPSQAYQLRLGYVILKDIQIIGHASATKKDVEGALKLTAEGKIQPIIAGTVGIDDIDKGYELLKDKNKIGKVLLKP

SEQ ID NO: 174 - protein, 334 aa, Sulfolobus acidocaldarius; identical to SEQ ID NO: 158

SEQ ID NO: 175 - protein, 333 aa, Sulfolobus solfataricus; identical to SEQ ID NO: 159

SEQ ID NO: 176 - protein, 331 aa, Metallosphaera yellowstonensis
MKAAVVPGKGQGLKVQEVPDPKPGKGEVLIKVTRAALCYRDLLQLQGYYPRMKYPVVLGHEVVGVIQEVGEGVNFSPGERVISLLYAPDGTCKYCRMGEEAYCRSRQGYSEELDGFFAEYAVVKAQSLVKVSSGASDEGAVMVPCVTGMVYRGLRRANLREGETVLVTGASGGVGIHALQVARAMGARVIGVTSSEEKAEAVKRYADRVIVGTKFSEEAKREEINVVVDTVGTPTFEESLRSLWLGGRVVQIGNVDPSQLTQLRLGYMILKDLVLIGHASSTKKDAEGALRLTAEGKITPVVAGTVTLEDIERGYELLKDKRKIGKVLVKP

SEQ ID NO: 177 - protein, 358 aa, Sulfolobus tokodaii
MRLTLQNHIVCADYGQVHLDARVVGQIMNYTAETWQPDRPKKERECNIEQGKIAEEITERFIRQYYSQELSLKTYDEIRNDDFKKHAPFDFLLWKTGTVNIAFIEEAIRQDIARTPNKFVKLSNVTRRLCRTLGVKIVEVKSTNIRNDLKVESDFTGDYDNVKSVQKLLETIRRKDDVFCYPKLKRRESDPGYCLDDYCREVQERFSEFDGCKGENLRRRVIAWECENQCCDIFVRVYLDRPAKKGFVIGWMQKEELLDDTVQFKRMRQKNKSELALYFAKNLGETKGIDCLAQAFGKPKQRVYANPYTPTNFYHKTDDCKFIRRVPKEELLIFDSEEAAIQNGRFINRCRECFSKDG

SEQ ID NO: 178 - protein, 141 aa, Sulfolobus acidocaldarius
MITDAIDHIGIAVENLDNSIDLYTNKLGFRVVHRETLPDRGIKVVFLAGSSGETTIELMEPINHDDETNTVVKFLKNRGPGLHHLAIKVSDIKQSLSELNILGIQLVDKTPRVGARGHLVAFIHPKSTIGVLIELVQVKDS

SEQ ID NO: 179 - protein, 142 aa, Sulfolobus islandicus
MLVENLDHIGIVVEDIDQAIKFYQNTFGMKLIHQELIPERGIKVAFLVGEEENETSIELLEPIDHNDMNNTVAKFLKNRGQGLHHLAVKVSDINKALEELTAKGLQLVDSAPRKGARGHLVAFVHPKSVMGVLLELVQPKEL

SEQ ID NO: 180 - protein, 141 aa, Sulfolobus acidocaldarius; identical to SEQ ID NO: 178

SEQ ID NO: 181 - protein, 142 aa, Sulfolobus solfataricus
MQIENLDHIGIVVGNLDEAIKFYQNTFGMKLVHYELIPERGIKVAFLVSNEKNETSIELLEPIDHNDMSNTVAKFLKNRGQGLHHLAIKVSDINRALEELTAKGLQLVDTSPRKGARGHLVAFLHPKSVMGVLLELVQAKEL

SEQ ID NO: 182 - protein, 142 aa, Sulfolobus solfataricus; identical to SEQ ID NO: 181

SEQ ID NO: 183 - protein, 141 aa, Metallosphaera yellowstonensis
MNTLGIDHVGVAVDNLEEAIKLYTEKVGMKLVHKEDLPDRGIRVAFLVGDDGVAAVELMEPMNHDDPNNTVAKFIKSKGQGMHHLAVKVRDISESLKEMEAMGMNLIDKGPRRGARGHLVAFVHPKSVMGVLLELVQEAHH

SEQ ID NO: 184 - protein, 142 aa, Sulfolobus islandicus; identical to SEQ ID NO: 179

SEQ ID NO: 185 - protein, 142 aa, Sulfolobus solfataricus; identical to SEQ ID NO: 181

SEQ ID NO: 186 - protein, 142 aa, Sulfolobus islandicus
MLVENLDHIGIVVEDIDQAIKFYQNTFGMKLIHQELIPERGIKVAFLVGEEENETSIELLEPIDHNDMNNTVAKFLKNRGQGLHHLAVKVSDVNKALEELTAKGLQLVDSAPRKGARGHLVAFVHPKSVMGVLLELVQPKEL

SEQ ID NO: 187 - protein, 142 aa, Sulfolobus islandicus; identical to SEQ ID NO: 179

SEQ ID NO: 188 - protein, 319 aa, Sulfolobus islandicus
MAAKGGTVKAASGFNAAEDAQTLRKAMKGLGTDEDAIINVLAYRSTAQRQEIRTAYKTTIGRDLMDDLKSELSGNFEQVILGMMTPTVLYDVQELRKAMKGAGTDEGCLIEILASRTPEEIRRINQTYQLQYGRSLEDDIRSDTSFMFQRVLVSLSAGGRDESNYLDDALMRQDAQDLYEAGEKKWGTDEVKFLTVLCSRNRNHLLHVFDEYKRIAQKDIEQSIKSETSGSFEDALLAIVKCMRNKSAYFAERLYKSMKGLGTDDDTLIRVMVSRAEIDMLDIRANFKRLYGKSLYSFIKGDTSGDYRKVLLILCGGDD

SEQ ID NO: 189 - protein, 140 aa, Metallosphaera cuprina
MDTLDIDHVGVAVENIDEAIKLYTGKMGMKLVHREDLPDRGIKVAFLTGKEGQTAVELMEPMNHEDQNNTVAKFLKTRGQGMHHLAVKVKDINESLKDLESKGLALIDKTGRKGARGHLVAFVHPKSVMGLLLELVQEAH

SEQ ID NO: 190 - protein, 142 aa, Sulfolobus islandicus
MLVENLDHIGIVVEDIDQAIKFYQNTFGMKLIHQELIPERGIKVAFLVGEEENETSIELLEPIDHNDMNNTVAKFLKNRGQGLHHLAVKVSDINKALEELTAKGLQLVDSAPRKGARGHLVAFVHPKSIMGVLLELVQPKEL

SEQ ID NO: 191 - protein, 142 aa, Sulfolobus islandicus; identical to SEQ ID NO: 179

SEQ ID NO: 192 - protein, 140 aa, Acidianus hospitalis
METQTIDHIGIVVENIDKAIDFYEKNLGMKLIDKEELKDRGIKVAFMVGKNGESAVELLEPINHDDMNNTVAKFLKTKGPGLHHLAIRVEDINKALEDLSAKGLQLVDKQPRPGARGHLVAFVHPKSVMGVLLELVQERL

SEQ ID NO: 193 - protein, 142 aa, Sulfolobus islandicus; identical to SEQ ID NO: 179

SEQ ID NO: 194 - protein, 142 aa, Sulfolobus islandicus; identical to SEQ ID NO: 179

SEQ ID NO: 195 - protein, 556 aa, Sulfolobus tokodaii
MESTDKIKEKYDEWVREFLLPTLRKLPEWRKFVTSFGVDVKPLYTPLDIKGEYLDKLGFPGEYPFTRGIYPSMYRSRLWTFREYSGFGSPEDTNRRYKFLISQGQTGLSVAFDLPTQLGLDPDHELAYPEVGKVGVSVPEVVSMSILFDGIDIGKITTSFTINATAAEILSMYITVAESRGIDKAVLDGTIQNDILKEFIARNLYIYPPLHSMRYATDIIAYTSKNLPKWHPISISGYHFREAGATAVQELAFTLADAIEYTNWVINRWKMNVDDFAPGLSFFFAATTNLFEEVAKFRAARRLYARIMKERFGVKKPESMRMKFHVQTSGAALTAQQPEVNIIRTTIQALAAVLGGAQSLHVNAYDEALALPTEKSVKLALRVQQVIAYESGVVDSIDPLGGSYYIEWLTDTIEEEVMKIIDYIDRLGGMTKAVEIGYPQRAIAESAYQYQRMVEEGKIAVIGVNMFREEEELHIELHRVDPVSRERSIKRVREVRESRDKEAWERALNELRRVADREDENVFPYILNAVKAKATVGEISGVLRDVWGEYKPPSIY

SEQ ID NO: 196 - protein, 565 aa, Aeropyrum pernix
MPFFDPEYVKRLEASLKKWESETLPQWLERMPERMESFTTLSDIPVRRLYTPLDLKDWDYLEKLGFPGEYPFTRGIHATMYRAKLWTMRMFSGYGGPEETNKRLKFLIEHGETGLSLAFDEPTLVGIDPDDPLAEGHVGIEGVNVASLKDMEIIFDGIDMGRVTTNMTINPPAPVLLSYYVAVAEKQGVPYHKIGGTTQNDPLKEFIAQKTYVFPPEAAVKIAIDVIEWSVKNLPKWNPISISGYHIREAGATAVQELAFTLADGIEYVRQLLARGLDVDTFAPRLSFFFDSHINFFEEIAKFRAARRMWAKIMKEWFGAKKKRSMWLRFHTQTAGVSLVVQEPYNNIVRTAIEALAAVLGGTQSLHTNSFDEPFRVPSEFAAKIALRTQQIIAYETGVADTIDPLGGSYYVEWLTDEIEERAWKYIDKIEAMGGMLEAVKRGYPQKEVTESAYKFQRDLEEGRKFIVGVNIFRSESIDEARNVPLLEFDQEEIEERQKRRVKEVRKMRNQERWRRALDNLRKAAERGENIMPYVLEAARAYATLGEIMGTLKEVYGVYVEPPEY

SEQ ID NO: 197 - protein, 556 aa, Vulcanisaeta moutnovskia
MENTDKIKEKYDEWVREFLLPTLKKVPEWRKFITSFGVEIKPLYTPLDVKDDYLDRLGFPGEYPLTRGIYPSMYRSRLWTFREYSGFGSPEDTNKRYKFLISQGQTGLSVAFDLPTQLGLDPDHELAYPEVGKVGVSVPEVVSMSILFDDIDISRITTSFTINATAAEILSMYITVAESRGIDKAVLDGTIQNDILKEFIARNLYIYPPLHSMRYTTDIIAYTSKNLPKWHPISISGYHFREAGATAVQELAFTLADAIEYTNWVINRWRMSVDDFAPGLSFFFAATTNLFEEIAKFRAARRLYARIMKERFGARKLESMKLKFHVQTSGAALTAQQPEVNIIRTTIQALAAVLGGAQSLHVNAYDEALSLPTEKSVKLALRVQQVIAYESGVIDSIDPLGGSYYIEWLTDTIEEEVMKIIDYTDKLGGMTKAVEIGYPQRAIAESAYRYQKMVEEGEIAVIGVNMFREEEKLHIEFHKVDPVSRERSIKRVREVRENRDREAWERALNELRRAADREDENVFPYILNAVRAKATIGEVSSVLRDVWGEYKPPSIY

SEQ ID NO: 198 - protein, 557 aa, Sulfolobus acidocaldarius
MDTDDKILEKSKEWEEKVLKPWISKRPERKNNFLTPSGILVKRLYTPLDQKGDYLSKLGFPGEYPYTRGIYPNMYRGRLWTIRQYAGYGSAEDTNYRFRKLLEAGQTGLSMAFDLPTQLGLDPDHKLAFTEVGVVGVSLFHWKEMDLVMSDIPIQKVTTSMTINATAIELLSMYIATAESRGISTSELDGTVQNDILKEYIARKNYIYPPEFGIRYAVDLIEYSSKNIPNWHPISISGYHIREAGADAILEVAFTLADGIEYVRKTIERGISVDDFAPKLSFFFAAYTNIFEEIAKFRAARRMWAKIMKEMFNAKKPESMMLRFHTQTGGAELTAQQPEINIIRTTLQALAAILGGTQSLHVNSYDEALGLPTEKAAKIAIRVQQVIAHESGATDTIDPIAGSYYVEWLTDEIEEHAWKILYDIERMGGMMKAIEVGYPQAQIAESSYRIQKRLEQNDLVRVGVNMYYEPDWIGTTEVFKVNPLVRDRILQRLAKYKKERDNSKVEGSLSRLRNAADKENVNIFPYILDAIKSGATVGEVSSVLRELWGEYKEPSLF

SEQ ID NO: 199 - protein, 559 aa, Sulfolobus acidocaldarius
MTMDTDDKILEKSKEWEEKVLKPWISKRPERKNNFLTPSGILVKRLYTPLDQKGDYLSKLGFPGEYPYTRGIYPNMYRGRLWTIRQYAGYGSAEDTNYRFRKLLEAGQTGLSMAFDLPTQLGLDPDHKLAFTEVGVVGVSLFHWKEMDLVMSDIPIQKVTTSMTINATAIELLSMYIATAESRGISTSELDGTVQNDILKEYIARKNYIYPPEFGIRYAVDLIEYSSKNIPNWHPISISGYHIREAGADAILEVAFTLADGIEYVRKTIERGISVDDFAPKLSFFFAAYTNIFEEIAKFRAARRMWAKIMKEMFNAKKPESMMLRFHTQTGGAELTAQQPEINIIRTTLQALAAILGGTQSLHVNSYDEALGLPTEKAAKIAIRVQQVIAHESGATDTIDPIAGSYYVEWLTDEIEEHAWKILYDIERMGGMMKAIEVGYPQAQIAESSYRIQKRLEQNDLVRVGVNMYYEPDWIGTTEVFKVNPLVRDRILQRLAKYKKERDNSKVEGSLSRLRNAADKENVNIFPYILDAIKSGATVGEVSSVLRELWGEYKEPSLF

SEQ ID NO: 200 - protein, 553 aa, Metallosphaera cuprina
MVTQERVNEWEKKYLNPWLAKRKERKVKFTTPSGIEVKSLYTPLDLKGDYEEKVGFPGEYPFTRGIYPNMYRGRIWTIRQYAGFGSAEDTNNRFKKLLEAGQTGLSTAFDLPTQLGLDPDNDLAYTEVGVVGVSMFHWREMDLVTNGIPLNKVSTSMTINATAMELLSMYAAVAESRGVSLTEIDGTVQNDILKEYIARKNYIYPPEQSMRYAIDIIEYSYKNIPKWHPISISGYHIREAGADAVLEVAFTLADGIEYVRKTLERGIPVDDFAPTLSFFFAGYTNLFEEVAKFRAARRMWAKIMRDMFNAKKADSMTLKFHTQTGGAELTAQQPEINIIRTTIQALAAALGGTQSLHVNSYDEAVALPSEKAAKIAIRVQQIVAYESGSTETVDPLAGSYYVEWLTDEIEERAWKIIERVEGMGGMMKAVEKGFPQAEIAESSYRLQKKVEEGDMIRVGVNMSYEPDWIGTTEVFRVRPEVRERVISRLKNYRSERDEMKVRDSINSLRRAAESPSTNLFPYVLDAIKKGCTVGEISGTLREIWGEYKEPIIF

SEQ ID NO: 201 - protein, 556 aa, Vulcanisaeta distributa; identical to SEQ ID NO: 195

SEQ ID NO: 202 - protein, 553 aa, Metallosphaera yellowstonensis
MVSGERVKEWENKVLATWLSKRKERKSKFITPSGIEVKPLYTPLDVKGDYEEKIGFPGDYPFTRGIYPNMYRGRIWTIRQYAGFGSSEDTNLRFRKLLEAGQTGLSMAFDLPTQLGLDPDHVLAYTEVGVVGVSMFHWKEMDLVMNSIPLDKVSTSMTINATAMELLSMYIATAERRGISQAQLDGTVQNDILKEYIARKNFIYPPEPSMRYAVDIIEYSYKNVPKWHPISISGYHIREAGADAVLEVAFTLADGIEYVRRTLERGIPVDDFAPTLSFFFAGYTNLFEEVAKFRAARRMWAKIMRDMFNAKKPDSMTLKFHTQTGGAELTAQQPEINIIRTTIQALAAALGGTQSLHVNSYDEAVALPSEKAAKIAIRVQQIVAYESGVTETVDPLAGSYYVEWLTDEIEERAWKVIERIEGMGGMMKAIERAYPQAEIAESAYRLQKRIEEGDMVKVGVNMSYEPDWIGTTEVFRVNPEVRERVIQRLKKYRSDRDEIKFRDSLNNLRKVAEKENVNMVPYVLDAIKKGATVGEISSTLREVWGEYREPIIF

SEQ ID NO: 203 - protein, 573 aa, Caldisphaera lagunensis
MYLMGCAMGNLYDKNSLKEIKKSLENWQNNVLPQWLQQVPEREKEFTNLSNIQIKNLYTPLDIEDFDYDSKLGFPGSYPFTRGIHATMYRARLWTMRMFSGFGGPEETNKRLKFLIEHGETGLSLAFDYPTLIGIDPDDPMAEGEVGIVGVSVPSIEDMRIVFDGINMGEVTTNMTINPPAPVLLSFYVGVAEMQGVPYYKIGGTTQNDPLKEFIAQKSYVFPPEPAVRVSMDLIEWSVKNLPKWNPISVSGYHIREAGSTAVQELAFTIADGIEYVRQLISRGLDVDEFAPRISFFWDSHINFFEEIAKFRAARRMWAKIMKDWFHAKKERSMWMRFHTQTAGVSLTAQQPWNNIIRTAIEAMAAVLGGTQSLHTNSFDEPFRVPSEFAAKIALRTQQIIAYESGIADTIDPLAGSYYVEWLTDEIEEQAWKYIDKIEKLGGMLEAVKKGFPQREVTEASYNYQKQVDEKKKYIVGVNIFEDNQVDEIRNVPLLEFDQAEIEKRQKARINKIKSERDKELWERSLNELRKAAEGDVNLMPYILQAAKAKATLGEIMSTLKEVFGAYVEPPIY

SEQ ID NO: 204 - protein, 561 aa, Sulfolobus solfataricus
MFIRFKHIMDVEDRIKEWEEKVYSSWVKKRGERKKEFKTFSGIHIKPVYTPLDVKGNYMEKLGLPGEYPFTRGIYPNMYRGRIWTIRQYAGFGSAEETNSRFRKLLEAGQTGLSMAFDLPTQLGLDPDHELAYTEIGVVGVSMFHWKEMDIVMSGIPLDKVTTSMTINATAMELLSMLIATSESRNINKSVLDGTVQNDILKEYIARKNFIYPPSPSMRYAIDIIEYSAKYLPKWHPISISGYHIREAGADAVLEVAFTLADGMEYVRKTMERGINVDEFAPHLSFFFAAYSDIFEEVAKFRAARRMWAKIMKEVFNAKKPESMMLRFHTQTGGAELTAQQPEINIIRTTLQALAAVLGGTQSLHVNSYDEALALPTEKAAKIAIRVQQIIANESGAADVVDPLGGSYYIEWLTDEIEERAWKIIDQVEKMGGMIKAIENGYPQAQIAESAYKIQKRIEEGDLGKVGVNMYYEPEWIGTTEIFRVNPEVRERVISRLKKYKQERDEMKLRESLNNLRKIAEKENENLFPYMIDAIRAGATVGETSGVLRDIWGEYKEPSIF

SEQ ID NO: 205 - protein, 553 aa, Sulfolobus solfataricus
MDVEDRIKEWEEKVYSSWVKKRGERKKEFKTFSGIHIKPVYTPLDVKGNYMEKLGLPGEYPFTRGIYPNMYRGRIWTIRQYAGFGSAEETNSRFRKLLEAGQTGLSMAFDLPTQLGLDPDHELAYTEIGVVGVSMFHWKEMDIVMSGIPLDKVTTSMTINATAMELLSMLIATSESRNINKSVLDGTVQNDILKEYIARKNFIYPPSPSMRYAIDIIEYSAKYLPKWHPISISGYHIREAGADAVLEVAFTLADGMEYVRKTMERGINVDEFAPHLSFFFAAYSDIFEEVAKFRAARRMWAKIMKEVFNAKKPESMMLRFHTQTGGAELTAQQPEINIIRTTLQALAAVLGGTQSLHVNSYDEALALPTEKAAKIAIRVQQIIANESGAADVVDPLGGSYYIEWLTDEIEERAWKIIDQVEKMGGMIKAIENGYPQAQIAESAYKIQKRIEEGDLGKVGVNMYYEPEWIGTTEIFRVNPEVRERVISRLKKYKQERDEMKLRESLNNLRKIAEKENENLFPYMIDAIRAGATVGETSGVLRDIWGEYKEPSIF

SEQ ID NO: 206 - protein, 553 aa, Sulfolobus islandicus
MDIEDRIKEWEETVYLSWVKKRGERKKEFKTFSGIHIKPVYTPLDVKGNYMEKLGLPGEYPFTRGIYPNMYRGRIWTIRQYAGFGSAEETNSRFRKLLEAGQTGLSMAFDLPTQLGLDPDHELAYTEVGVVGVSMFHWKEMDMVMSGIPLDKVSTSMTINATAMELLSMLIATTESRNINKNVLDGTVQNDILKEYIARKNFIYPPSPSMRYAIDIIEYSAKYLPKWHPISISGYHIREAGADAVLEVAFTLADGMEYVRKTMERGISVDEFAPHLSFFFAAYSDIFEEVAKFRAARRMWAKIMKEMFNAKKLESMMLRFHTQTGGAELTAQQPEINIIRTTLQALAAVLGGTQSLHVNSYDEALALPTEKAAKIAIRVQQIIANESGAADIVDPLGGSYYIEWLTNEIEERAWKIIDQVEKMGGMIKAIENGYPQAQIAESAYRIQKRIEESDLGKVGVNMYYEPEWIGTTEIFRVNPEVRERVISRLKKYKQERDGMKVRDSLNNLRKAAEKENENLFPYMIDALRVGATVGETSSVLRDIWGEYKEPSIF

SEQ ID NO: 207 - protein, 553 aa, Sulfolobus islandicus
MDIEDRIKEWEEKVYLSWVKKRGERKKEFKTFSGIHIKPVYTPLDAKGNYMEKLGLPGEYPFTRGIYPNMYRGRIWTIRQYAGFGSAEETNLRFRKLLEAGQTGLSMAFDLPTQLGLDPDHELAYTEVGVVGVSMFHWKEMDMVMSGIPLDKVSTSMTINATAMELLSMLIATTESRDINKNVLDGTVQNDILKEYIARKNFIYPPSPSMRYAIDIIEYSAKYLPKWHPISISGYHIREAGADAVLEVAFTLADGMEYVRKTMERGISVDEFAPHLSFFFAAYSDIFEEVAKFRAARRMWAKIMKEMFNAKKLESMMLRFHTQTGGAELTAQQPEINIIRTTLQALAAVLGGTQSLHVNSYDEALALPTEKAAKIAIRVQQIIANESGAADVVDPLGGSYYIEWLTDEIEERAWKIIDQVEKMGGMIKAIENGYPQAQIAESAYRIQKRIEESDLGKVGVNMYYEPEWIGTTEIFRVNPEVRERVISRLKKYKQERDGMKVRDSLNNLRKVAEKENENLFPYMIDAIRAGATVGETSGVLRDIWGEYKEPSIF

SEQ ID NO: 208 - protein, 553 aa, Sulfolobus islandicus
MDIEDRIKEWEEKVYLSWVKKRGERKKEFKTFSGIHIKPVYTPLDVKGNYMEKLGLPGEYPFTRGIYPNMYRGRIWTIRQYAGFGSAEETNLRFRKLLEAGQTGLSMAFDLPTQLGLDPDHELAYTEVGVVGVSMFHWKEMDMVMSGIPLDKVSTSMTINATAMELLSMLIATAESRDINKNVLDGTVQNDILKEYIARKNFIYPPSPSMRYAIDIIEYSAKYLPKWHPISISGYHIREAGADAVLEVAFTLADGMEYVRKTMERGISVDEFAPHLSFFFAAYSDIFEEVAKFRAARRMWAKIMKEMFNAKKLESMMLRFHTQTGGAELTAQQPEINIIRTTLQALAAVLGGTQSLHVNSYDEALALPTEKAAKIAIRVQQIIANESGAADVVDPLGGSYYIEWLTDEIEERAWKIIDQVEKMGGMIKAIENGYPQAQIAESAYRIQKRIEESDLGKVGVNMYYEPEWIGTTEIFRVNPEVRERVISRLKKYKQERDGMKVRDSLNNLRKVAEKENENLFPYMIDAIRAGATVGETSGVLRDIWGEYKEPSIF

SEQ ID NO: 209 - protein, 553 aa, Sulfolobus islandicus
MDIEDRIKEWEETVYLSWVKKRGERKKEFKTFSGIHIKPVYTPLDVKGNYMEKLGLPGEYPFTRGIYPNMYRGRIWTIRQYAGFGSAEETNSRFRKLLEAGQTGLSMAFDLPTQLGLDPDHELAYTEVGVVGVSMFHWKEMDMVMSGIPLDKVSTSMTINATAMELLSMLIATTESRNINKNVLDGTVQNDILKEYIARKNFIYPPSPSMRYAIDIIEYSAKYLPKWHPISISGYHIREAGADAVLEVAFTLADGMEYVRKTMERGINVDEFAPHLSFFFAAYSDIFEEVAKFRAARRMWAKIMKEMFNAKKLESMMLRFHTQTGGAELTAQQPEINIIRTTLQALAAVLGGTQSLHVNSYDEALALPTEKAAKIAIRVQQIIANESGAADIVDPLGGSYYIEWLTDEIEERAWKIIDQVEKMGGMIKAIENGYPQAQIAESAYRIQKRIEESDLGKVGVNMYYEPEWIGTTEIFRVNPEVRERVISRLKKYKQERDGMKVRDSLNNLRKAAEKENENLFPYMIDALRVGATVGETSSVLRDIWGEYKEPSIF

SEQ ID NO: 210 - protein, 553 aa, Sulfolobus solfataricus; identical to SEQ ID NO: 205

SEQ ID NO: 211 - protein, 551 aa, Acidianus hospitalis
MDIDEKIKEWNNLYTSWIAKRKERKQKFITPSGIEVKPLYTPLDLKGNYVDKIGFPGMYPFTRGIYPNMYRGRIWTIRQYAGFGSAEDTNLRFRKLLEAGQTGLSMAFDLPTQLGLDPDQELAFTEVGVVGVSMFHWKEMDLVMNQIPMDKVTTSMTINATAMELMSMYIATAESRGIDKKVLDGTVQNDILKEYIARKNFIYPPEPSLRYAIDLIEYSYKNIPKWHPISISGYHIREAGADAVLEVAFTLADGIEYVRKTLERGINVDDFAPTLSFFFAGYTNIFEEVAKFRAARRMWAKIMKEWFNAKKPDSMTLKFHTQTGGAELTAQQPEINIIRTTLQALAAVLGGTQSLHVNSYDEALALPSEKAAKIAIRVQQIIAYESGATETVDPLAGSYYIEWLTDEIEERAWKVIDNIEKMGGMLKAIERGYPQAEIAESSYRLQKRIEEGDIIKVGVNFAYESDWIGTTEIFRVNPAVRERVISRLKQYKENRDNIKWKDSLEKLRKAAEGNDNLFPYVLDAIKAGATIGEISSVLREVWGEYKEPIIF

SEQ ID NO: 212 - protein, 553 aa, Sulfolobus islandicus
MDIEDRIKEWEETVYLSWVKKRGERKKEFKTFSGIHIKPVYTPLDVKGNYMEKLGLPGEYPFTRGIYPNMYRGRIWTIRQYAGFGSAEETNSRFRKLLEAGQTGLSMAFDLPTQLGLDPDHELAYTEVGVVGVSMFHWKEMDMVMSGIPLDKVSTSMTINATAMELLSMLIATTESRNINKNVLDGTVQNDILKEYIARKNFIYPPSPSMRYAIDIIEYSAKYLPKWHPISISGYHIREAGADAVLEVAFTLADGMEYVRKTMERGISVDEFAPHLSFFFAAYSDIFEEVAKFRAARRMWAKIMKEMFNAKKLESMMLRFHTQTGGAELTAQQPEINIIRTTLQALAAVLGGTQSLHVNSYDEALALPTEKAAKIAIRVQQIIANESGAADIVDPLGGSYYIEWLTDEIEERAWKIIDQVEKMGGMIKAIENGYPQAQIAESAYRIQKRIEESDLGKVGVNMYYEPEWIGTTEIFRVNPEVRERVISRLKKYKQERDGMKVRDSLNNLRKAAEKENENLFPYMIDALRVGATVGETSSVLRDIWGEYKEPSIF

SEQ ID NO: 213 - protein, 553 aa, Sulfolobus islandicus
MDIEDRIKEWEEKVYLSWVKKRGERKKEFKTFSGIHIKPVYTPLDAKGNYMEKLGLPGEYPFTRGIYPNMYRGRIWTIRQYAGFGSAEETNLRFRKLLEAGQTGLSMAFDLPTQLGLDPDHELAYTEVGVVGVSMFHWKEMDMVMSGIPLDKVSTSMTINATAMELLSMLIATTESRDINKNVLDGTVQNDILKEYIARKNFIYPPSPSMRYAIDIIEYSAKYLPKWHPISISGYHIREAGADAVLEVAFTLADGMEYVRKTMERGISVDEFAPHLSFFFAAYSDIFEEVAKFRAARRMWAKIMKEMFNAKKLESMMLRFHTQTGGAELTAQQPEINIIRTTLQALAAVLGGTQSLHVNSYDEALALPTEKAAKIAIRVQQIIANESGAADVVDPLGGSYYIEWLTDEIEERAWKIIDQVEKMGGMIKAIENGYPQAQIAESAYRIQKRIEESDLGKVGVNMYYEPEWIGTTEIFRVNPEVRERVISRLKKYKQERDGMKVRDSLNNLREVAEKENENLFPYMIDAIRAGATVGETSGVLRDIWGEYKEPSIF

SEQ ID NO: 214 - protein, 553 aa, Sulfolobus islandicus; identical to SEQ ID NO: 212

SEQ ID NO: 215 - protein, 553 aa, Sulfolobus islandicus; identical to SEQ ID NO: 208

SEQ ID NO: 216 - protein, 553 aa, Sulfolobus islandicus; identical to SEQ ID NO: 213

SEQ ID NO: 217 - protein, 566 aa, Sulfolobus acidocaldarius
MGATFNNDEIKKISDKASEWRRTTLQQWLQRLPERQQEFTTLSDIPIKEVYTPADIPNFDYMEKLGLPGEYPFTRGIHATMYRARLWTMRMFSGYGSPEDTNKRLKFLIEHGETGLSLAFDYPTLVGIDPDDPMAEGEVGIVGVSVPTIVDMEVVFDGIDMGKVTTNMTINPPAPVLLSFYVAVAEKQGVPYSQIGGTTQNDPLKEFMAQKSYVFPPEPAVKVAMDLIEWSVKNLPKWNPISISGYHIREAGATAVQELAFTLADGIEYVRQLKNRGLDVDFFAPRLSFFFDAHINFFEEIAKFRAARRMWAKIMRDWFGAKNPRSWWLRFHTQTAGVSLTAQQPWNNIVRTAIEALAAVLGGTQSLHTNSFDEPFRVPSEFAAKIALRTQQIIAYETGVADTIDPLAGSYYVEWLTDEIEERAWKYIDKIESMGGMLEAVKKGFPQREIADAAYKFQKDVEEGRRFIVGVNIFTENEVEDVRKVPLLEFDQQEIEKKQKQRIAQVRSMRDQQRWSRALDELRKAAEKGENIMPYILNAVKAYATLGEIMNTLKEVYGVYVEPPIY

SEQ ID NO: 218 - protein, 142 aa, Sulfolobus tokodaii
MLMSQKRIKVLVAKLGLDGHDRGAKVIARALKDAGMEVVYTGLRQTPEQIVKSAIQEDVDVIGISILSGAHLELVPYVVNLMREKGLNDVVLVVGGVIPPQDIPKLKEMGVDEVFLPGSSLKEVVEKITKAVETKRGIKIAS

SEQ ID NO: 219 - protein, 161 aa, Aeropyrum pernix
MSSLQSTRERVLGTPRRRYKVLVAKMGLDGHDRGAKVVARALRDAGFEVVYTGLRQTPEQVAMAAVQEDVDVIGVSILNGAHLHLMKRLMAKLRELGADDIPVVLGGTIPIPDLEPLRSLGIREIFLPGTSLGEIIEKVRKLAEEKRMREEAEASEQVGQA

SEQ ID NO: 220 - protein, 141 aa, Sulfolobus islandicus
MMITTKRIKVIVAKLGLDGHDRGAKVVARALKDAGMEVVYTGLRQTPEQIVKAALQEDADVIGISILSGAHLELIPKVIEIMRQNGLNDVGLIVGGVIPPDDIKKLKDMGVDEVFLPGSSLKEIVEKVKKVARQKRGIDVE

SEQ ID NO: 221 - protein, 141 aa, Sulfolobus islandicus; identical to SEQ ID NO: 220

SEQ ID NO: 222 - protein, 141 aa, Sulfolobus islandicus; identical to SEQ ID NO: 220

SEQ ID NO: 223 - protein, 141 aa, Sulfolobus solfataricus
MMITTKRIKVIVAKLGLDGHDRGAKVVARALKDAGMEVVYTGLRQTPEQIVRAALQEDADVIGISILSGAHLELIPKVVEIMKQNGLNDVGLIVGGVIPPEDIKKLKEMGVDEVFLPGSSLKEIVEKVKKVAREKRGISVE

SEQ ID NO: 224 - protein, 141 aa, Sulfolobus islandicus; identical to SEQ ID NO: 220

SEQ ID NO: 225 - skipped

SEQ ID NO: 226 - protein, 141 aa, Sulfolobus islandicus; identical to SEQ ID NO: 220

SEQ ID NO: 227 - protein, 141 aa, Sulfolobus islandicus; identical to SEQ ID NO: 220

SEQ ID NO: 228 - protein, 141 aa, Sulfolobus islandicus; identical to SEQ ID NO: 220

SEQ ID NO: 229 - protein, 141 aa, Sulfolobus islandicus; identical to SEQ ID NO: 220

SEQ ID NO: 230 - protein, 141 aa, Sulfolobus islandicus; identical to SEQ ID NO: 220

SEQ ID NO: 231 - protein, 131 aa, Vulcanisaeta distributa
MPKPKIIIAKLGLDGHDRGAKVVARALAEAGFEVVYTGIRQTPSQVVETAIQEDAKLIGISILSGSHMELVGELMRIMKERGLNIPVLVGGIIPPEDRDALLKMGVAGVYGPGTPLREIIEIVKKLVGAQQ

SEQ ID NO: 232 - protein, 139 aa, Metallosphaera cuprina
MEKRIKVVVAKLGLDGHDRGAKVVARALKDAGMEVVYTGLRQTPEQIVRTAIQEDADVIGISILSGAHLELIPKIVEAMRKVGLNDVGLIVGGVIPPEDIDRLKSMGVDEVFLPGTSLKEIANKVTNLAIAKRGIRVER

SEQ ID NO: 233 - protein, 146 aa, Caldisphaera lagunensis
MLSPQYTKTEQFKVLVAKLGIDGHDRGAKVIARALKDAGFEVIYTGIRQTPQQIVSSALQEDVDVIGISILSGAHIHHMKMLMEELKNAGASDIPVVIGGTIPIIDVDELKKIGVREVFLPGESLRKIVEIIRKLAEEKRKLELRG

SEQ ID NO: 234 - protein, 139 aa, Metallosphaera yellowstonensis
MDKRIKVIVAKLGLDGHDRGAKVIARALKDAGMEVVYTGLRQTPQQIVKTAIQEDADVIGVSILSGAHLELVPQIVEAMRNAGLNDVGLVVGGVIPPEDISKLKSMGVDEVFLPGTGLKEIIAKVSSVAGKKRGIKVEQ

SEQ ID NO: 235 - protein, 140 aa, Sulfolobus acidocaldarius
MKRIKVLVAKLGLDGHDRGAKVVARALKDAGMEVVYTGLRQTPEQIVKAAIQEDVDVIGVSILSGAHIELISMLVKEMKDKKLNDVGLVVGGVIPPQDIPALKQLGVDEVFLPGSSLKEITEKIIKVASDKRGLSFEPVR

SEQ ID NO: 236 - protein, 163 aa, Sulfolobus acidocaldarius
MVPGSNPGGPRLKNLNSLNLILSMKRIKVLVAKLGLDGHDRGAKVVARALKDAGMEVVYTGLRQTPEQIVKAAIQEDVDVIGVSILSGAHIELISMLVKEMKDKKLNDVGLVVGGVIPPQDIPALKQLGVDEVFLPGSSLKEITEKIIKVASDKRGLSFEPVR

SEQ ID NO: 237 - protein, 141 aa, Sulfolobus solfataricus; identical to SEQ ID NO: 223

SEQ ID NO: 238 - protein, 141 aa, Acidianus hospitalis
MEKRIKVIVAKLGLDGHDRGAKVVARALKDAGMEVVYTGLRQTPSQIVKTAIQEDADVIGVSILSGAHLELIPPLVNLMKENGLTDVGLIVGGVIPPQDIEKLKNMGVDEVFLPGSSLKEIVEKVKKVAEKKRGIKIGQTT

SEQ ID NO: 239 - protein, 141 aa, Sulfolobus solfataricus; identical to SEQ ID NO: 223

SEQ ID NO: 240 - protein, 147 aa, Sulfolobus acidocaldarius
MSSLQYTEERPYKVIVAKLGLDGHDRGAKVIARALKDAGFEVVYTGIRQTPEQVARAAIEEDADVIGVSILSGAHVHHVRLLIEKLKELGGEDIPVVVGGTIPIVDVDELKRLGVKEVFLPGESLSKMAEIIRELAAKKRQLEALMG

SEQ ID NO: 241 - protein, 130 aa, Vulcanisaeta moutnovskia
MPKPKIIIAKLGLDGHDRGAKVIARALAEAGFEVVYTGIRQTPSQVVETAIQEDAKLIGISILSGSHLELVGELMRIMKEKGVSIPVLVGGIIPPEDKEALLKMGIAGVYGPGTSLKEIIDIVKKLVGVS

SEQ ID NO: 242 - protein, 361 aa, Sulfolobus tokodaii
MRAAVLFNYKEPLKIEEVEIEDPKENEVMVQVVATGLCHSDINVFVGATPVPPPVVAGHEIAGIVKKVGPGVTRVKPGDRVISAFIHPCGKCKNCISGHENLCETFSSVRLKGTMFDGTTRLRLKNGTIVRTFLGGGFAEYAIVHENALTVVPQDMDLQKVAVLGCAGITGYGAVDSAKIEPGETVAVIGVGGVGLSIIQLLKASGAGRIIALGTKKWKLEKAMELGATDVINTKETDPIKALKEVTNGGPDVVIEAGGTQETVQMAIESVRIGGRVVLVGLPPVSAQIPLRIAMIVRNGITILGNYGGRPRIDMPRLLELVRSGKYDPGKLVTGKYRLEEVNEAVKLLEEGEAIRSLIIP

SEQ ID NO: 243 - protein, 363 aa, Sulfolobus acidocaldarius
MLAGVLHNYKEPITVEEVEIEEPKENEVMIEVKATGMCHSDVNVFLGSTPVPTPVIAGHEIAGRVVKVGHNVSRVKEGDRVISTFIQPCGKCKNCISGMENLCETFASVRLKGTMFDGTTRVKYKDGRSIRTFLGGGFAEYSIVHENALTRMEDSNVNIEELAVLGCSGITAYGAISSANVRPGDSVAVVGVGGVGLSVIQMLRAVGAGRIIALGTKKWKLEKALELGATDFINTKESEPVKTLKEMTNGGPDIIIEAGGTQETIQMALEGVRIGGKVVLIGLPPTSALIPVRVSMIVRNGITIIGNYGSKPRVDMPKLVELVRTKRYDPQKLITGKFKLEEINEAVKLLEEGLAIRSLIIPH

SEQ ID NO: 244 - protein, 371 aa, Sulfolobus solfataricus
MIILYLILMKGAILYKYNEPLIIEDNIQIDEPKVGETKIRIEATGLCHSDVNVFEGKTPVPPPVIAGHEIAGVIEEVGNNVTDFKPGDRVISAFIHPCGKCKNCITGKENLCEVFAKNRLNGTLLDGTTRLHFKDGTPIRAFLGGGFAEYAMVPYTALTKVPEDLDLRKVAVLGCAGLTAYGAVNSAKIEPGETVAVIGVGGVGLSVIQMLKIAGAGRIIAVGTRKWKLEKALELGASDVVNSKETDVVRAVKNITGGGPDVVIEVAGTTETVKMSLDMVRIGGKVVLVGLPPTTAEIPIRIASIVRGGIKIIGDYGGRPRVDMPRLIELVKLGKYDPTALVTGKFRLEEINEAVKLLEQGEAIRSLIIPN

SEQ ID NO: 245 - protein, 371 aa, Sulfolobus solfataricus
MLILYLIVMKGAILYKYNEPLIIEDNIKIDSPKNNEVKIRVEATGLCHSDVNVFEGKTPVPPPVIAGHEIAGIVDEVGDNVTDFKPDDRVISAFIHPCGRCKNCITGKENLCEVFAKNRLNGTLLDGTTRLHFKDGTPIRAFLGGGFAEYTIVPYTALTKVPEDLDLRKVAVLGCAGLTAYGAVNSAKIEPAETVAVIGVGGVGLSIIQMLKIAGAGRIIAIGTKKWKVEKALELGASDVINPKETDAIRAVKNITGGGPDVVMEVAGTTETVKMSLDMVRMGGRVVLVGLPPTSAEIPIRIASIVRGGIKIIGNYGGRPRVDMPRLIELVKMGKYDPTALVTGKFKLEEINDAVKLLEQGEAIRSLIIPN

SEQ ID NO: 246 - protein, 371 aa, Sulfolobus islandicus
MIILYLILMKGAILYKYNEPLIIEDNIQIDDPKVGETKIRIEATSLCHSDVNVFEGKTPVPPPVIAGHEIAGVIEEVGNNVTDFKPGDRVISAFIHPCGKCKNCITGKENLCEVFAKNRLNGTLLDGTTRLHFKDGTPIRAFLGGGFAEYAMVPYTALTKVPEDLDLRKVAVLGCAGLTAYGAVNSAKIEPGETVAVIGVGGVGLSVIQMLKIAGAGRIIAVGTRKWKLEKALELGASDVVNSKETDVVRAVKNITGGGPDVVIEVAGTTETVKMSLDMVRIGGKVVLVGLPPTSAEIPIRIASIVRGGIKIIGDYGGRPRVDMPRLIELVKLGKYDPTALVTGKFRLEEINEAVKLLEQGEAIRSLIIPN

SEQ ID NO: 247 - protein, 371 aa, Sulfolobus islandicus
MIILYLILMKGAILYKYNESLIIEDNIQIDEPKVGETKIRIEATGLCHSDVNVFEGKTPVPPPVIAGHEIAGVIEEVGNNVTDFKPGDRVISAFIHPCGKCKNCITGKENLCEVFAKNRLNGTLLDGTTRLHFKDGTPIRAFLGGGFAEYAMVPYTALTKVPEDLDLRKVAVLGCAGLTAYGAVNSAKIEPGETVAVIGVGGVGLSVIQMLKIAGAGRIIAVGTRKWKLEKALELGASDVVNSKETDVVRAVKNITGGGPDVVIEVAGTTETVKMSLDMVRIGGKVVLVGLPPTTAEIPIRIASIVRGGIKIIGDYGGRPRVDMPRLIELVKLGKYDPTALVTGKFRLEEINEAVKLLEQGEAIRSLIIPN

SEQ ID NO: 248 - protein, 371 aa, Sulfolobus islandicus
MIILYLILMKGAILYKYNEPLIIEDNIQIDDPKVGETKIRIEATGLCHSDVNVFEGKTPVPPPVIAGHEIAGVIEEVGNNVTDFKPGDRVISAFIHPCGKCKNCITGKENLCEVFAKNRLNGTLLDGTTRLHFKDGTPIRAFLGGGFAEYAMVPYTALTKVPEDLDLRKVAVLGCAGLTAYGAVNSAKIEPGETVAVIGVGGVGLSVIQMLKIAGAGRIIAVGTRKWKLEKALELGASDVVNSKETDVVRAVKNITGGGPDVVIEVAGTTETVKMSLDMVRIGGKVVLVGLPPTTAEIPIRIASIVRGGIKIIGDYGGRPRVDMPRLIELVKLGKYDPTALVTGKFRLEEINEAVKLLEQGEAIRSLIIPN

SEQ ID NO: 249 - protein, 371 aa, Sulfolobus islandicus
MIILYLILMKGAILYKYNEPLIIEDNIQIDEPKVGETKIRIEATGLCHSDVNVFEGKTPVPPPVIAGHEIAGVIEEVGNNVTDFKPGDRVISAFIHPCGKCKNCITGKENLCEVFAKNRLNGTLLDGTTRLHFKDGTPIRAFLGGGFAEYAMVPYTALTKVPEDLDLRKVAVLGCAGLTAYGAVNSAKIEPGEIVAVIGVGGVGLSVIQMLKIAGAGRIIAVGTRKWKLEKALELGASDVVNSKETDVVRAVKNITGGGPDVVIEVAGTTETVKMSLDMVRIGGKVVLVGLPPTTAEIPIRIASIVRGGIKIIGDYGGRPRVDMPRLIELVKLGKYDPTALVTGKFRLEEINEAVKLLEQGEAIRSLIIPN

SEQ ID NO: 250 - protein, 371 aa, Sulfolobus islandicus
MIILYLILMKGAILYKYNEQLIIEDNIQIDEPKVGETKIRIEATGLCHSDVNVFEGKTPVPPPVIAGHEIAGVIEEVGNNVTDFKPGDRVISAFIHPCGKCKNCITGKENLCEVFAKNRLNGTLLDGTTRLHFKDGTPIRAFLGGGFAEYAMVPYTALTKVPEDLDLRKVAVLGCAGLTAYGAVNSAKIEPGETVAVIGVGGVGLSVIQMLKIAGAGRIIAVGTRKWKLEKALELGASDIVNSKETDVVRAVKNITGGGPDVVIEVAGTTETVKMSLDMVRIGGKVVLVGLPPTTAEIPIRIASIVRGGIKIIGDYGGRPRVDMPRLIELVKLGKYDPTALVTGKFRLEEINEAVKLLEQGEAIRSLIIPN

SEQ ID NO: 251 - protein, 371 aa, Sulfolobus islandicus; identical to SEQ ID NO: 246

SEQ ID NO: 252 - protein, 371 aa, Sulfolobus islandicus
MIILYLILMKGAILYKYNEPLIIEDNIQIDDPKVGETKIRIEATGLCHSDVNVFEGKTPVPPPVIAGHEIAGVIEEVGNNVTDFKSGDRVISAFIHPCGKCKNCITGKENLCEVFAKNRLNGTLLDGTTRLHFKDGTPIRAFLGGGFAEYAMVPYTALTKVPEDLDLRKVAVLGCAGLTAYGAVNSAKIEPGETVAVIGVGGVGLSVIQMLKIAGAGRIIAVGTRKWKLEKALELGASDVVNSKETDVVRAVKNITGGGPDVVIEVAGTTETVKMSLEMVRIGGKVVLVGLPPTTAEIPIRIASIVRGGIKIIGDYGGRPRVDMPRLIELVKLGKYDPTALVTGKFRLEEINEAVKLLEQGEAIRSLIIPN

SEQ ID NO: 253 - protein, 362 aa, Acidianus hospitalis
MKGAVLYKYNEPLKIEDNLQIQSPKEGEVKVKIVATGMCHSDINVFEGKTPVPPPVIAGHEIAGIVEEVGPGVTRVKPGDRVVSAFIHPCGKCRNCISGHENLCETFSAVRLKGTMMDGTTRVRLDGKEVRTFLGGGFAEYAVVGENALTVVPPEVDLEKIAVLGCAGLTGYGAVNSAKIEPGESVAVIGVGGVGLSVIQLLKASGAGRIIAVGTKKWKLDRAIELGATDVVNSKETDPIKAIKELTNGGADVVIEAGGNEETIKMAMDSVRIGGRVVLVGLPPVNAMIPFRVASIVRNGITIIGNYGGRPRIDMPRLLDLVRLGKYDPSKLITGRFKLEEINEAVKLLNQGEAIRSLIIPD

SEQ ID NO: 254 - protein, 371 aa, Sulfolobus islandicus
MIILYLILMKGAILYKYNEPLIIEDNIQIDDPKVGETKIRIEATGLCHSDVNVFEGKTPVPPPVIAGHEIAGVIEEVGNNVTDFKPGDRVISAFIHPCGKCKNCITGKENLCEVFAKNRLNGTLLDGTTRLHFKDGTPIRAFLGGGFAEYAIVPYTALTKVPEDLDLRKVAVLGCAGLTAYGAVNSAKIEPGETVAVIGVGGVGLSVIQMLKIAGAGRIIAVGTRKWKLEKALELGASDVVNSKETDVVRAVKNITGGGPDLVIEVAGTTETVKMSLEMVRIGGKVVLVGLPPTTAEIPIRIASIVRGGIKIIGDYGGRPRVDMPRLIELVKLGKYDPTALVTGKFRLEEINEAVKLLEQGEAIRSLIIPN

SEQ ID NO: 255 - protein, 371 aa, Sulfolobus islandicus
MIILYLILMKGAILYKYNEPLIIEDNIQIDEPKVGETKIRIEATGLCHSDVNVFEGKTPVPPPVIAGHEIAGVIEEVGNNVTDFKPGDRVISAFIHPCGKCKNCITGKENLCEVFAKNRLNGTLLDGTTRLHFKDGTPIRAFLGGGFAEYAMVPYTALTKVPEDLDLRKVAVLGCAGLTAYGAVNSAKIEPGETVAVIGVGGVGLSVIQMLKIAGAGRIIAVGTRKWKLEKALELGASDIVNSKETDVVRAVKNITGGGPDVVIEVAGTTETVKMSLDMVRIGGKVVLVGLPPTTAEIPIRIASIVRGGIKIIGDYGGRPRVDMPRLIELVKLGKYDPTALVTGKFRLEEINEAVKLLEQGEAIRSLIIPN

SEQ ID NO: 256 - protein, 363 aa, Sulfolobus acidocaldarius; identical to SEQ ID NO: 243

SEQ ID NO: 257 - protein, 360 aa, Metallosphaera cuprina
MRAAVLNAYKEPLSVEDVKIAEPKSGEVKIKVRATGLCHSDVNVFEGKTPVPPPVIAGHEISGIVEETGPGVTRVKPGDRVISAFIHPCGKCSNCIEGKENLCETFSQVRLKGVMPDGTSRITKEGKEIRTFLGGGFAEYAIVGENALTKVPDELDLEKVAVLGCAGLTGYGAITSSNIEPGDTVAVIGVGGVGLSTIQLLRASGAGRIIAVGTKKWKLDRAMELGATDTINSKETDPVKAIRDMTGGGPKVVIEAGGNEETIHMALDMVKIGGRVVLIGLPPASSMIPLRIASVVRGGIQIVGNYGGRPRVDMPKLIELVREGRYDPSRLVTGRFRLEEINEAVKLLESGEAIRSLIIP

SEQ ID NO: 258 - protein, 371 aa, Sulfolobus solfataricus; identical to SEQ ID NO: 245

SEQ ID NO: 259 - protein, 360 aa, Metallosphaera yellowstonensis
MKAAVLHAYKEPLRIEEVDISPPRRGEVLIRVKATGLCHSDVNVFEGKTPVPPPVVAGHEIAGVVEQVGEGVTRVRPGDRVISAFIHPCGTCRNCVSGHENLCETFSSVRLKGIMPDGSSRLSMGGKEIRAFLGGGFAEEAVVGENALTKIPEGMELERLAVLGCAGLTGYGAVLAGKVEPGETVAVIGVGGVGLSTIQVLRSAGAGRIIAVGTKKWKLERAMELGATDTVNSKEEDPVKALKEMTGGGPDVVVEAGGNEETIRMALDAVRIGGRVVLVGLPPSSAMIPLKVASIVRGGITVVGNYGARPRVDMPRLMELIKQGKYDPSALVTGRFKLEEINEAVKLLEEGEAIRSLIVP

SEQ ID NO: 260 - protein, 662 aa, Metallosphaera cuprina
MSNQESELNLPVKEKIVPESLKTKTIDPKDYLTFHKLTLDNNLEFWESIAKELEWFKPWERTLDSSNPPFYKWFVGGELNASYLAVDRHFRSWRRNKVALIWEGEPWDSSPREVRKLTYLDLFREVNKTAYLLKSYGLKRGDKIGIYLPMIPELPIFMLAAARLGLIFSVVFSGFSAQALADRMNDAGAKLLITADGGWRRGKVVQLKEIVDKALEMNKSIKDVIVVRRTGSEVRMEKGRDSFLHDLMSQVPNNAYVEPERVKSEDPLYILYTSGTTGKPKGIVHDTGGYMTLLHLTMRQVFDLRDEDVYWCTADVGWVTGHSYIVFGPLLEGATEVMYEGALDYPEPDRWVSIIERHQVSILYTSPTAIRTFMRQGERWITKHDVSSIRLIHSVGEPINPEAWRWFFKLVGREQVPFGSTWWMTETGGIMISHTPGGYLVPMKPGTNALPLPGIGAEVVNEEGKVKSGEKGYLVLTKPWPGMPLTIYGDPDRYVKVYWEKFPGAFYAGDYAIKDQDGYFWILGRADEVLKIAGHRIGTYELESALIQHPSIAEAAVVGVPDQVRGEVAEAFVILRSGVEPNQGLKDEINRFVRDNFGPIAVFKDIHFVSKLPKTRSGKIMRRVIRAVASNSPIGDVTTLEDEASVDEIRNAYKEFMREVKK

SEQ ID NO: 261 - protein, 498 aa, Sulfolobus solfataricus
MASYEEVRRSFSWSEVIRYLDENPLDVLTSHDGIAVKRFTKNAMEEISFSDLKRKALRLALYLKEFHNIKKGDVIAILASKKIQQIIVFLATLSLGAIYQPLFTAFGPEAIKMRTRDVKPKIIFCQDDQKDKINDAILFSKFDELLSYGELKEIEKINWDDAIILLYTSGTTGTPKGALIAKRLFLNIYVYMKYGIGVRENDVFWNPADPGWAYGLYYGIIGPLMFGKTIIFLDEPFNPERTMEFMEENKVTNFAFAPTAYRMIAGTVKKKYDLVLERASSAGEPLNPEVIRWFMDKYNVTIKDHYGQTEVGMVVYNGWGYDAKVKIGSMGLPAPGYEVDIIEDIIAVKRDSPGFHFLGYLNNPEKTKESFRGDWYLTGDNAYKDEEGYLWFVGRKDDVVKVSGYRIGPFEVESVLLEFPAVLESAVVADEDPIRGHVLHAYIVLKSGYTPSEELKKEIIDFVNTKYSRHVHLERVDFVDKLPKTESGKIQRYLLRKK

SEQ ID NO: 262 - protein, 497 aa, Sulfolobus solfataricus
MVSYEEVRRSFSWNEVIKFLDKNPLDVLTSHDGIAIKRFTKDVVEDISFSDLKRKALRLALYLREFHDVKKGDVIAVLASKKIEQVIVLLATFSLGAIYQPLFTAFGPEAIKMRTRDAKPKVIFYQDDQKDKVSDAIPFSKFDELLSYGELKNIEKINWDDPIVLLYTSGTTGAPKGALIAKRLLLNTYVYMKYGIGIRDSDVFWNPADPGWAYGLYYGIIGPLMFGKTVIFLDEPFNPERTMEFMEEKKVTNFAFAPTAYRMIAGTIKRKYDLVLERASSAGEPLNPEVIRWFMDNYNVTIKDHYGQTEVGMVVYNGWGYETKIKIGSMGLPAPGYEIDVIEDTIAVKRDSPGFHFLGYLNNPEKTKESFRGDWYLTGDNAYKDEEGYFWFVGRKDDVVKVSGYRVGPFEVESVLLEFPAVLESAVVADEDIRGHVLHAYIVLKSGYTPSEELKKEIINFVNSKYSRHVHLEKVDFVDKLPKTESGKIQRYLLRKK

SEQ ID NO: 263 - protein, 562 aa, Sulfolobus acidocaldarius
DFIDIQKLNPLDRPERINDLFTRLNFLGKIEDFNWVRDIYEEIHVKDRGGKTALMWYDLDTKVEEIYTYQDLLIRANKLINFLNPGIGKGDPVYLMTPVFPEQWVTFLATIKAGFVLVPTANNLTAYELGYRFADLKPKVIIADPKSAERIDQALGDLKPLKIVVRGRVNGWTDFELTQSESESAEAYPTSSEDDILNYFTSGTTGLPKRVIHTATSYPLGHLSTASIIGVSTEDIHLNLSAPGWAKFAWSSFFSPLIVGATIMAVNYEGRLNAQEYLSVVDNFNVTSFCAPPTAWRLFNLVDLWKFKFHKLRNVVSAGEPLNPEIIKVWKDKFDLTIRDFYGQTETTAIIGNPPWRDVTPGSFGIPSPLYDVVLLDDEGKEITKPFDVGHIAIRLTKWRAIPLFKGYSNEEKNKEAFRNGYYFTGDKGYFDDKGNWYFVARADDVIKTSDYRVGPFEVESALIEHPAVAEAAVVGSPDPVRWQLVKAFVVLKPGYSPSYELAKELVNHVSKSLSPYKVPRKIEFVNELPKTISGKIRRNELRKLEEDRYKKGEKSENEYTF

SEQ ID NO: 264 - protein, 555 aa, Thermoproteus uzoniensis
MSEEIDLRKYSFSSYNELYSSFKWNIPEYFNIGYAIIDRNVERGFGDRLAIYYLDDEGNRYSLTFGELKKLSDGLASSLRDIGVGRGDVVGVYLQPRPEVVVALSAIYRLGAIALSISPLIGTEGVEYRLRHSGAKALIAEGARRDVLDAVSKIEHLRAIYVVGSEPRGGKEYSLEDQSRSGRRIDAVATRSEDPAQLFYTSGSTGPPKGVLHAHRFLLGHVPTYQLYFEMAPREDDVFWTNADWGWIGALGDVVLPSLYFGRPVVAYRRSRGFSAGDALKVMEEYGVTAAFITPTALRMIRREYPQPLKDFGLRLRAVSTAGEAPGRELVEWASQAFRAPVNEFYGCTETNLVVTNNSLWARPGSIGRPAPGHVVDVVDEEGRPLPPGSEGLIAVKLPDPVAFLGYWKNPEATAAKIKNGWFIIGDAGVKDGDGYLWFKGRVDDVIKVAGYRLGPEEIEEVVAKHPAVLEAAVIGKPDPVRGTIVKAFVVLKPGVEPSEELKRDIQNFVKSRLAAYAYPREIEFVDQLPRTETGKLKRYELRRREMERGNVQGG

SEQ ID NO: 265 - protein, 659 aa, Sulfolobus acidocaldarius
MESLSESPSKQEIELLPYGEKYHPYHNKYVDFWRQSLADPMRFWDERARELVWYRTWDRVLDDSNPPFYRWFVGGETNVNLNALDRWMNTHVANKVAYYWEGEDGTTRVLSYRDLFREVNKFARALQDLGVKPNDTVTIYLPMIPELPISMLAVTRIGGIHSVVFSGFSPSALADRIVDAKSRVLITADGYWRKGKVVELKKNADEGVRLAEERGAKVDKVIVVRRLGNQVAWNEGRDVWYHELVSKYPENTYVKPVPRKADDVLFILYTSGTTGKPKGIMHSVGGYMVYVYNVFKWNWDIRPEDVHWTMADVGWITGHTYIVYGPLLNGATEVMYEGAIDYPQPDRPWQIVERYGVTIFYTSPTALRMLRQYGDEWVKKHDLSTLRILGTVGEPINPDVWKWYFEVVGRGKCPIVDTWWMTETGAAMIAPAPGISLVQLKPGSATFPMPGIEADVLDESGKPTPPGVKGYLVIKRPWPGMLLGVWGDPERYVKTYWSRFPGYFYPGDYAVKDEEGYFWLLGRADEVLKVAGHRIGTAELEDTLIKHPAVAEAAVIGVPDPIKGEVPVAAVVLKAGYRPSEDLKKELIDMIRTNIGPIATPQAILFVSKLPKTRSGKIMRRLLKDIMEGRPLGDTTTLEDPTAVDELKRAWDEFKSQMR

SEQ ID NO: 266 - protein, 522 aa, Metallosphaera yellowstonensis
MELQSLIREFISLQERGFTEREITRPNEIGHIAVRLVPRPLGLFMGYSDQKKNEEAFRYGYYFTGDKIKEFFQNLIKVDLTKFNWVRDVVEQVHLKDRASKTALHWRDMSTGEEETLTYHQLSLMANKVLNHLRKAGMRKGDPLYLMSRVHPLHWATFMASLKGGFVLVPSATNLTVNELKYRFSDLRPKAIVSDTLRARTVEEALGEMKVEKFLIDGKKQGWNSLEDGEVTNAEAEDTMGNDVVINYFTSGTTGMPKRVIHTAVSYPLGSLSTASIIGVKESDRHLNLSATGWAKFAWSSFFSPLLVGSTIVGLNYEGRLDSRKYLSEVEALGVTSFCAPPTAWRQFVTLNLKEFRMDKLRSVVSAGEPLNPEVMKAWREGTGDKAYMDEDGYFYFVSRGDDVIKTSDYRVGPFEVESALLEHPAVAEAAVVASPDPVRYQLVKAFVVLKPGYVPSEQLAKEIREKVKSLLSYYKVPRIIEFVSELPKTISGKIRRVELRRLEEERRRRGEKGEHEYFFTQ

SEQ ID NO: 267 - protein, 498 aa, Sulfolobus islandicus
MASYEEVRRSFSWSEVIRYLDENPLDVLTSHDGIAVKRFTKNAMEEISFSDLKRKALRLALYLKEFHNIKKGDVIAILASKKIQQIIVLLATLSLGAIYQPLFTAFGPEAIKMRTRDVKPKIIFCQDDQKDKINDAILFSKFDELLSYGELKEIEKINWDDAIILLYTSGTTGTPKGALIAKRLFLNIYVYMKYGIGVRENDVFWNPADPGWAYGLYYGIIGPLMFGKTIIFLDEPFNPERTMEFMEENKVTNFAFAPTAYRMIAGTVKKKYDLVLERASSAGEPLNPEVIRWFMDKYNVTIKDHYGQTEVGMVVYNGWGYDAKVKIGSMGLPAPGYEVDIIEDIIAVKRDSPGFHFLGYLNNPEKTKESFRGDWYLTGDNAYKDEEGYLWFVGRKDDVVKVSGYRIGPFEVESVLLEFPAVLESAVVADEDPIRGHVLHAYIVLKSGYTPSEELKKEIIDFVNTKYSRHVHLERVDFVDKLPKTESGKIQRYLLRKK

SEQ ID NO: 268 - protein, 498 aa, Sulfolobus islandicus
MASYEEVRRSFSWSEVIRYLDKNPLDVLTSNDGIAVRRFTKNAMEEISFSDLKRKALRLALYLKEFHNVKKGDVIAVLASKKIQQVIILLATLSLGAIYQPLFTAFGPEAIKMRTRDVKPKVIFCQDDQKDKVNNAISFSKFDELLSYGELKEIEKINWDDAIILLYTSGTTGTPKGALIAKRLLLNTYVYMKYGIGVRENDVFWNPADPGWAYGLYYGIIGPLMFGKTIIFLDEPFNPERTMEFMEENKVTNFAFAPTAYRMIAGMVKKKYDLVLERASSAGEPLNPEVIRWFMDKYNVTIKDHYGQTEVGMVVYNGWGYDAKVKIGSMGLPAPGYEVDIIEDIIAVKRDSPGFHFLGYLNNPEKTKESFRGDWYLTGDNAYKDEEGYLWFVGRKDDVVKVSGYRIGPFEVESVLLEFPAVLESAVVADEDPIRGHVLHAYIVLKSGYTPSEELKKEIIDFVNTKYSRHVHLERVDFVDKLPKTESGKIQRYLLRKK

SEQ ID NO: 269 - protein, 498 aa, Sulfolobus islandicus
MASYEEVRRSFSWIEVIRYLDKNTLDVLTSHDGIAVKRVTKNAVEKISFSDLKRKALRLALYLKEFHNVKKGDVIAVLASKKIQQVIILLATLSLGAIYQPLFTAFGPEAIRMRTGDVKPKVIFCQDDQKDKVNNAISFSKFDELLSYGELKEIEKINWDDAIILLYTSGTTGTPKGALIAKRLLLNTYVYMKYGIGIRENDVFWNPADPGWAYGLYYGIIGPLMFGKTIIFLDEPFNPERTMEFMEENKVTNFAFAPTAYRMIAGTVKKKYDLVLERASSAGEPLNPEVIRWFMDKYSVTIKDHYGQTEVGMVVYNGWGYDAKVKIGSMGLPAPGYEVDIIEDIIGVKRDSPGFHFLGYLNNPEKTKESFRGDWYLTGDNAYRDEEGYLWFVGRKDDVVKVSGYRIGPFEVESVLLEFPAVLESAVVADEDPIRGHVLHAYIVLKSGYTPSEELKKEIIDFVNTKYSRHVHLERVDFVDKLPKTESGKIQRYLLRKK

SEQ ID NO: 270 - protein, 574 aa, Sulfolobus acidocaldarius
MANELIKNLVRDFIDIQKLNPLDRPERINDLFTRLNFLGKIEDFNWVRDIYEEIHVKDRGGKTALMWYDLDTKVEEIYTYQDLLIRANKLINFLKSSGIGKGDPVYLMTPVFPEQWVTFLATIKAGFVLVPTANNLTAYELGYRFADLKPKVIIADPKSAERIDQALGDLKPLKIVVRGRVNGWTDFELTQSESESAEAYPTSSEDDILNYFTSGTTGLPKRVIHTATSYPLGHLSTASIIGVSTEDIHLNLSAPGWAKFAWSSFFSPLIVGATIMAVNYEGRLNAQEYLSVVDNFNVTSFCAPPTAWRLFNLVDLWKFKFHKLRNVVSAGEPLNPEIIKVWKDKFDLTIRDFYGQTETTAIIGNPPWRDVTPGSFGIPSPLYDVVLLDDEGKEITKPFDVGHIAIRLTKWRAIPLFKGYSNEEKNKEAFRNGYYFTGDKGYFDDKGNWYFVARADDVIKTSDYRVGPFEVESALIEHPAVAEAAVVGSPDPVRWQLVKAFVVLKPGYSPSYELAKELVNHVSKSLSPYKVPRKIEFVNELPKTISGKIRRNELRKLEEDRYKKGEKSENEYTF

SEQ ID NO: 271 - protein, 498 aa, Sulfolobus islandicus
MASYEEVRRSFSWSEVIRYLDENPLDVLTSHDGIAVKRFTKNAMEEISFSDLKRKALRLALYLKEFHNIKKGDVIAILASKKIQQIIVLLATLSLGAIYQPLFTAFGPEAIKMRTRDVKPKIIFCQDDQKDKINDAILFSKFDELLSYGELKEIEKINWDDAIILLYTSGTTGTPKGALIAKRLFLNTYVYMKYGIGVRENDVFWNPADPGWAYGLYYGIIGPLMFGKTIIFLDEPFNPERTMEFMEENKVTNFAFAPTAYRMIAGTVKKKYDLVLERASSAGEPLNPEVIRWFMDKYNVTIKDHYGQTEVGMVVYNGWGYDAKVKIGSMGLPAPGYEVDIIEDIIAVKRDSPGFHFLGYLNNPEKTKESFRGDWYLTGDNAYKDEEGYLWFVGRKDDVVKVSGYRIGPFEVESVLLEFPAVLESAVVADEDPIRGHVLHAYIVLKSGYTPSEELKKEIIDFVNTKYSRHVHLERVDFVDKLPKTESGKIQRYLLRKK

SEQ ID NO: 272 - protein, 498 aa, Sulfolobus solfataricus
MASYEEVRRSFSWSEVIRYLDENPLDVLTSHDGIAVKRFTKNAMEEISFSDLKRKALRLALYLKEFHNIKKGDVIAILASKKIQQIIVFLATLSLGAIYQPLFTAFGPEAIKMRTRDVKPKIIFCQDDQKDKINDAILFSKFDELLSYGELKEIEKINWDDAIILLYTSGTTGTPKGALIAKRLFLNIYVYMKYGIGVRENDVFWNPADPGWAYGLYYGIIGPLMFGKTIIFLDEPFNPERTMEFMEENKVTNFAFAPTAYRMIAGTVKKKYDLVLERASSAGEPLNPEVIRWFMDKYNVTIKDHYGQTEVGMVVYNGWGYDAKVKIGSMGLPALGYEVDIIEDIIAVKRDSPGFHFLGYLNNPEKTKESFRGDWYLTGDNAYKDEEGYLWFVGRKDDVVKVSGYRIGPFEVESVLLEFPAVLESAVVADEDPIRGHVLHAYIVLKSGYTPSEELKKEIIDFVNTKYSMHVHLERVDFVDKLPKTESGKIQRYLLRKK

SEQ ID NO: 273 - protein, 562 aa, Metallosphaera cuprina
MIQDFFKKLVKAQKDLNREKIEEIVNELHKLNVYRFNWVRDVFEQTHVKERASKTALVWRDMDSKDESRLTYYEMDVLANKVLNTFRKHGLNKGSVIYLMTKVHPMHWAVFLAVIKGGLVLVPSATNLTVSELKYRFSDLKPDAVVADSLRAPVLEQALGSLPVKKFLIDDKKWGWNAFEEESTNAEPTDTYKDDVVLNYFTSGTTGMPKRVLHTATSYPLGSITTASFMGINEEDVHLNLSATGWAKFAWSSFFSPLLVGATVAAINYEGKLDPKRYLTEVEDLRVSSFCAPPTAWRQFIGLELGAYKLDRLRSIVSAGEPLNPEVIKLWKEKFGVIIRDFYGQTETTAIIGNFPFLKIKPGSMGIPHPLYDVVLLDENGVAITKPHETGYIAIKLNPRPIGLFLGYSDQSKNQEVFKGGYYYTGDKAYMDEDGYFFFVGRGDDVIKTSDYRVGPFEVESALLEHPAVVEAAVVGVPDPIRWQLVKAFVVIRKEYAPSRELAEEIREKARVVLSPYKVPRIIEFVDELPKTISGKIRRIELRKLEEERRKRGEKPKNEFSF

SEQ ID NO: 274 - protein, 583 aa, Sulfolobus islandicus
MWERKRYINRRGILLYMRNMVEIIREKKIILRPNLENYEEVRKNFSWSKVREELNYNGDVNAAELAIHKKGELGDKYGILWVSEEEEKRKYTFRDLERRGATFRRVLEDNGVRSGDRVVIMSKRVPALYFSFVAIGMLGSVILPIFSTFGEDAIRYRVENSGAKVAIVHESLAEKFRNIHGIKILKITDDGIEGESNRGVEISYTKRSINDPFLILYTSGTTGKPKGIWHSQDILTFYYVSGKYHFDMHPQDVFWHTGDPAWVAGFAGVWTAWVNGIPLVSYEGRFKAETWYSNIQEYRVSVISTAPTALRLLKKEGLELAKKYDLSSVRFVHAGGEYVDPDTVKAGIEIFGVPVHDGYGQTETATYVIANFISMPIKIGSMGKPLPGVEAVIVDENGNPLPPNTQGILALKPDFPAMARGIWGDEERWKRNFKNGYYLTGDTAYVDEDGYFWYLGRSDDVIKVSGYRVSPIEIESVIATHPAVAEAGVIALEDPVRGHKIKAYIVLKKNYEPSEELKQQIQNYVRERLAAHMVPREIEFVSELPHTLSGKIMRRVLKAMESGREVGDISTLENPEIVKKSKE

SEQ ID NO: 275 - protein, 583 aa, Sulfolobus islandicus
MWERKRYINRRGILLYMRNMVEIIRDKKIILRPNLENYEEVRKNFSWSKVREELNYNGDVNAAELAIHKKGELGDKYGILWVSEEEEKRKYTFRDLERRGATFRRVLEDNGIRSGDRVVIMSKRVPALYFSFIAIGMLGSVILPIFSTFGEDAIRYRVENSGAKVAIVHESLVEKFRNIHGIKILKITDDGIEGESNRGVEISYTKRSINDPFLILYTSGTTGKPKGIWHSQDILTFYYVSGKYHFDMHPQDVFWHTGDPAWVAGFAGVWTAWVNGIPLVSYEGRFKAETWYSNIQEYRVSVISTAPTALRLLKKEGLELAKKYDLSSVRFVHAGGEYVDPDTVKAGIEIFGVPVHDGYGQTETATYVIANFISTPIKIGSMGKPLPGVEAVIVDENGNPLPPNTQGILALKPDFPAMARGIWGDEERWKRNFKNGYYLTGDTAYVDEDGYFWYLGRSDDVIKVSGYRVSPIEIESVIATHPAVAEAGVIALEDPVRGHKIKAYIVLKKNYEPSEELKQQIQNYVRERLAAHMVPREIEFVSELPHTLSGKIMRRVLKAMESGREVGDISTLENPEIVKKSKK

SEQ ID NO: 276 - protein, 583 aa, Sulfolobussolfataricus
MWERKRYINRRGILLYMRNMVEIIREKKIILRPNLENYEEVRKNFSWSKIREELNYNGDVNAAELAIHKKGELGDKYGILWVSEDDEKRKYTFRDLEKRGATFRRVLEDNGVRSGDRVVIMSKRVPALYFSFVAIGMLGSVILPIFSTFGEDAIRYRVENSGAKVAIVHESLVEKFRNIHGIKILKITDDGIEGESNRGVEISYTKRSINDPFLILYTSGTTGKPKGIWHSQDILTFYYVSGKYHFDMHPQDVFWHTGDPAWVAGFAGVWTAWVNGIPLVSYEGRFKAETWYSNIQEYRVSVISTAPTALRLLKKEGLELAKKYDLSSVRFVHAGGEYVDPDTVKAGIEIFGVPVHDGYGQTETATYVIANFISMPIKIGSMGKPLPGVEAVIVDENGNPLPPNTQGILALKPDFPAMARGIWGDEERWKRNFKNGYYLTGDTAYVDEDGYFWYLGRSDDVIKVSGYRVSPIEIESVIATHPAVAEAGVIALEDPVRGHKIKAYIVLKKNYEPSEELKQQIQNYVRERLAAHMVPREIEFVSELPHTLSGKIMRRVLKAMESGREVGDISTLENPEIVKKSKK

SEQ ID NO: 277 - protein, 498 aa, Sulfolobus islandicus
MASYEEVRRSFSWSEVIRYLDKNPLDVLTSHDGIAVKRFTKNAMEEISFSDLKRKALRLALYLKEFHNIKKGDVIAILASKKIQQIIVLLATLSLGAIYQPLFTAFGPEAIKMRTRDVKPKIIFCQDDQKDKINDAILFSKFDELLSYGELKEIEKINWDDAIILLYTSGTTGTPKGALIAKRLFLNTYVYMKYGIGVRENDVFWNPADPGWAYGLYYGIIGPLMFGKTIIFLDEPFNPERTMEFMEENKVTNFAFAPTAYRMIAGTVKKKYDLVLERASSAGEPLNPEVIRWFMDKYNVTIKDHYGQTEVGMVVYNGWGYDAKVKIGSMGLPAPGYEVDIIEDIIAVKRDSPGFHFLGYLNNPEKTKESFRGDWYLTGDNAYKDEEGYLWFVGRKDDVVKVSGYRIGPFEVESVLLEFPAVLESAVVADEDPIRGHVLHAYIVLKSGYTPSEELKKEIIDFVNTKYSRHVHLERVDFVDKLPKTESGKIQRYLLRKK

SEQ ID NO: 278 - protein, 498 aa, Sulfolobus islandicus; identical to SEQ ID NO: 268

SEQ ID NO: 279 - protein, 498 aa, Sulfolobus islandicus; identical to SEQ ID NO: 269

SEQ ID NO: 280 - protein, 397 aa, Sulfolobus tokodaii
MINMDAYIVSAVRTPIGKFGGVFKDLPPYELGAIAIKEALKRANVDPAKVDITIMGNILRAGHGQDLARQAAIRAGIPMEIDGYCVDMVCSSGMVSVINAVQMIKSGDADIVVAGGMESMSQAMLAIRSEARWGVKMLLGKKLDFIDTMLIDGLTDPFNMKLMGQEADMVAKSHNISRRELDEVAYESHKRAIIATEKGYFAKEIVSVKVDGKEVTQDEGIRRDTSIEKLSQLKPAFSPDGVHTAGNSSQISDGSSALVIVSEKIVKEYKLEPIAKILGYSWVGIESWRFTEAPIFAVKKLLQKLNMEISHFDYFENNEAFAVNNVLYNKYLGVPYDRLNVFGGAIALGHPIGASGARIITTLINVLSTMGGKRGIASICHGTGGSTAIAIELLRPL

SEQ ID NO: 281 - protein, 395 aa, Thermoproteus uzoniensis
MREVWIVGYARTPIGKFGGALKDIKTAHLAAFAIRKALERIGLDGKLVEEVIIGSTLQGGQGQSLARQAALYAGLPVTTSAYTVNRVCSSGMQAVIDAYREIALGDADIVVAGGAESMSTAPLAFSSETRWGVKHLIGRGQQLLDLMVYDGLTDPTNGLLMGEEAEMVAKEWGITRQELDQVAYESHMRAWKATENKWFLDMEPIEDTLGGVQVKLDRDEGIRPDTNLEKLAKLKPAFRPDGVLTAGNSSQLSDGAAALVLASSDKAKELGLKPVAKILGYSWHMVEPWRFVEAPIYAVQKLVKKIGMGLDQFDYFENNEAFAVNNILFHRVLQVPYERLNVFGGAVALGHPLGASGARIITTLISVLKVKGGRRGIAALCHGTGGGTAVALEII

SEQ ID NO: 282 - protein, 396 aa, Metallosphaera cuprina
MNEVYIVSAVRTPIGRFGGSLKSVKPVDLGAIVIREALNRANLDPSRVEITIMGNVLRAGHGQDVARQAALKAGIPWEVDGYSVDMVCSSGMMSVTNAAQIIKNEDADIVVAGGIESMSQAMLAVSSEVRWGVKFLSGKSLSFIDTMLQDGLTDPFNFKLMGQEADMVAKERDISRRELDEIALESNRRAHQAWEKGIFNSETVPVRLNEGKLDRDEGIRQDTNLEKLASLKPAFTENGVHTAGNSSQISDGAAALVLMSEKAVKEYGVEPVARIMGYSWVGIESWRFTEAPIFSIKKLLSKLNLTVNHFDYFENNEAFAVNNVLLHKFLNVPYEKLNVFGGAIAIGHPIGASGARIIVTLLNVLSKMQGKRGIASICHGTGGSTALAVELMRPIG

SEQ ID NO: 283 - protein, 397 aa, Sulfolobus solfataricus
MPESVYIASAVRTPIGKFGGALRNLSPVDLGSIVIREALRRANVEPGKIDMAIMGNVLRAGHGQDIARQCAISAGIPFEIDGFSVDMVCSSGMISVITASQMIKSGDADIIVAGGTENMSQAMFAIKSDIRWGVKMLMNRNIELIDTMLYDGLTDPFQYKVMGQEADMVAKSHNISRKELDEVAYQSHLRAHKATVNGYFKSEIVEIKADGKVINTDEGIRADTSLDKLSSLPPAFTDDGLHTAGNSSQISDGAAALVLVSEKAAKELKIEPIARILGYSWVGIESWRFTEAPIFAIKKLLSKLDTDINHFDYFENNEAFAVNNVLINRYLGIPYDRLNVFGGAIALGHPIGASGARIIVTLLNVLSKMHGTRGIASICHGIGGSTAIAIELLKEMK

SEQ ID NO: 284 - protein, 404 aa, Sulfolobus islandicus
MNECIFSMPESVYIASAVRTPIGKFGGTLKNLSPVDLGSIVIREALRRAYVEPSKVDIAIMGNVLRAGHGQDIARQCAIRAGIPYEIDGFSVDMVCSSGMMSIITASQMIKSGDADIIVAGGTESMSQAMFTIKSDIRWGVKMLMNRSIELIDTMLYDGLTDPFLQKVMGQEADMVAKAHNISRKELDEVAYQSHLRAHKATVNGYFKSEIVEIKTDGKVVNVDEGIRADTSLDKLSTLPPAFTDGGPHTAGNSSQISDGATALVLMSEKAIKELKIEPIARILGYSWVGIESWRFTEAPIFAIKKLLNKLNIDINHFDYFENNEAFAVNNVLVNRYLGIPYDRLNVFGGAIALGHPIGASGARIIVTLLNVLSKMRGARGIASICHGIGGSTAVAIELLREMK

SEQ ID NO: 285 - protein, 395 aa, Acidianus hospitalis
MTEVYIASAVRTPIGKFGGVFKDISPVDLGAIAIKEALKRANVDPKRVDIVIMGNILRAAFGQDLARQAAVKAGIPYEIDGYSVDMVCSSGMMSITNAVELIKTGDADIVVAGGMESMSQAALAVRSHVRWGVKMLMGKQLEFVDTMLMDGLTDPFNMKLMGEEADMVAKAHNFTRQELDEVAYQSHKRAAEATEKGLFASEIVPVEVNGTLITKDEGIRADTSIEKLSKLKPAFSKDGFHTAGNSSQLSDGASALVLMSEKAVKEFGVDPLARVLGFSWAGIESWRFTEAPIFAVKKLLQKLNMDISKFDYFENNEAFAVNSVLANRYLGIPYDRLNVFGGAIALGHPIGASGARIVTTLINVLSKMKGERGIASICHGTGGSTAMAIELLRPL

SEQ ID NO: 286 - protein, 392 aa, Thermoproteus neutrophilus
MDVVVVGYVRTPIGKFGGAFKDVKPPHLAAFTIKKLLERTGVDGKLVEEVIFGSTLQGGVGQNVARYAALLAGLPVDVSAFTVNRVCSSGMQAIIEAYREIALGDASVVIAGGVESMSTQPICVSHEARWGLRHSIGRRFELTDLMVFDGLTDPATGMLMGEEADMVAKEHKIAREELDKVAYESHMRAWRATENKWFDDMEPVEGEFGGVKLDRDEGIRPDTSLEKLAKLKPAFKPDGLHTAGNSSQLSDGAAALLLMSEEKARELGVKPIARILGYSWHMLEPWRFTEAPVYAIQKLLRKLGVSVDYFDYYEANEAFAVVNVLVNRVLGVPYDRMNVFGGAIALGHPLGASGTRIVTTLISVLRRMGGRRGVAALCHGTGGGTAVALELI

SEQ ID NO: 287 - protein, 392 aa, Sulfolobus acidocaldarius
MDNVYIVSAVRTPLGKFGGSLKDISPSELGSVVIREAVNRAKVDPKLIDIVIMGNVLRAGHGQDLARQASIKAGIPAKTDAYCVDMVCSSGMISTINAVQMIKSEDADIVVAGGMESMSRASFAIGSEIRWGTKMLMNKSLDIIDTMIIDGLTDPFNFKVMGQEADMVAREHEITRRELDEVAYESHRRATIATEKGYFKDEIVPLNVDGRVVDKDEGIRADTTLEKLLQLKPAFGSDGLHTAGNSSQISDGAAALVFVSESAVRKFKLEPIARVLGYSWIGIESWKFPEAPIYSVKKLLDKINIPLSKFDYFENNEAFAVNNVLFNRYLGVSYDRLNVYGGAIALGHPIGASGSRILVTLLNVLRKMNGKYGIASICHGIGGSTAIAVELL

SEQ ID NO: 288 - protein, 404 aa, Sulfolobus islandicus
MNECIFSMPESVYIASAVRTPIGKFGGTLKNLSPVDLGSIVIREALRRAYVEPSKVDIAIMGNVLRAGHGQDIARQCAIRAGIPYEIDGFSVDMVCSSGMMSIITASQMIKSGDADIIVAGGTESMSQAMFTIKSDIRWGVKMLMNRNIELIDTMLYDGLTDPFLQKVMGQEADMVAKAHNISRKELDEVAYQSHLRAYKATVNGYFKSEIVEIKTDGKVVNVDEGIRADTSLDKLSTLAPAFTDGGPHTAGNSSQISDGATALVLMSEKAIKELKIEPIARILGYSWVGIESWRFTEAPIFAIKKLLNKLNIDINHFDYFENNEAFAVNNVLVNRYLGIPYDRLNVFGGAIALGHPIGASGARIIVTLLNVLSKMRGARGIASICHGIGGSTAVAIELLREMK

SEQ ID NO: 289 - protein, 404 aa, Sulfolobus islandicus; identical to SEQ ID NO: 284

SEQ ID NO: 290 - protein, 404 aa, Sulfolobus islandicus
MNECIFSMPESVYIASAVRTPIGKFGGTLKNLSPVDLGSIVIREALRRAYVEPSKVDIAIMGNVLRAGHGQDIARQCAIRAGIPYEIDGFSVDMVCSSGMMSIITASQMIKSGDADIIVAGGTESMSQAMFTIKSDIRWGVKMLMNRNIELIDTMLYDGLTDPFLQKVMGQEADMVAKAHNISRKELDEVAYQSHLRAYKATVNGYFKSEIVEIKTDGKVVNVDEGIRADTSLDKLSTLPPAFTDGGPHTAGNSSQISDGATALVLMSEKAIKELKIEPIARILGYSWVGIESWRFTEAPIFAIKKLLNKLNIDINHFDYFENNEAFAVNNVLVNRYLGIPYDRLNVFGGAIALGHPIGASGARIIVTLLNVLSKMRGARGIASICHGIGGSTAVAIELLREMK

SEQ ID NO: 291 - protein, 404 aa, Sulfolobus islandicus; identical to SEQ ID NO: 288

SEQ ID NO: 292 - protein, 404 aa, Sulfolobus islandicus; identical to SEQ ID NO: 284

SEQ ID NO: 293 - protein, 394 aa, Pyrobaculum calidifontis
MGIVIAGFVRTPIGKFGGALKDVKTPHLAAFVIKKLLERTGLSGKEVDEVVFGSTLQGGMGQNLARYAALLAGLPVEVSAYTVNRVCSSGMQAIIEAYREIAVGDASVVIAGGAESMSTPPICLPDDARWGLRHFIGRRAELRDLMVYDGLTDPSNGLLMGEEAELVAREHKITREELDWVAYESHMRAWRATENRWFEEMEPIDGELGGVRVKLDRDEGIRPDTTLEKLAKLKPAFRPDGVLTAGNSSQLSDGAAALLLTTEEKAKELSLRPVARILGYSWHMVEPWRFVEAPLYAVQKLLKKLGMGINDFDYFENNEAFAVNNVLFHRFLDVPYDKLNVFGGAIALGHPLGASGARIVTTLISVLRRMGGRRGIAALCHGTGGGTALAIELV

SEQ ID NO: 294 - protein, 407 aa, Pyrobaculum arsenaticum
MNTNYLATSNLPSVEVVIVGYARTPIGKFGGGLKDVKTAHLAAFAIRKALDRAGVEGKFVDEVIIGSTLQGGQGQSLARQAALYAGLPVTTSAYTVNRVCSSGMQAVIEAYREIALGDADIVVAGGAESMSTAPLAFAPEVRWGVKHLIGRGQQLLDLMVYDGLTDPVNGLLMGEEAEMVAKEWGLTRQELDLVAYESHMRAWRATENKWFLDLEPIDDVLGGVRVKLDRDEGIRPDTTVEKLAKLKPAFKPDGVLTAGNSSQLSDGAAVLVLASADKAKELGLKPVAKVLGYSWHMVEPWRFIEAPIYAVQKLFKKLGMDASQFDYFENNEAFAVNNVLFHKALQVPYDKLNVFGGAIALGHPLGASGARIITTLISVLKVKGGRRGIAALCHGTGGGTALAVELI

SEQ ID NO: 295 - protein, 404 aa, Sulfolobus islandicus; identical to SEQ ID NO: 290

SEQ ID NO: 296 - protein, 396 aa, Ignicoccus hospitalis
MSEIYIISAVRTPIGKFLGSLSGIPAPDLAAIAAKEAIKRAGIEPKDVDFYAFGNVIGAAVGQNPARRTALLAGIPYEVDGHTVNLVCSSGMMAMIDAIRAFKAGDAKIALVGGMESMSRAPLCLPPEARSGIKHLVGREAKLIDTMVLDGLTDSWNWQLMGVEADMTAKKYGAKREELDWIAYQSHMRAAKATDEGIFEKEIVPIEVKTKKGVVTIKSDEGIRRDTSPEKLAKLPPAFTPDGVHTAGNSSQLSDGAAALIMAPEEVVNEYGLKPVARVLAYDIVGLKPEDFVEAPVPGIKRISEKVGVKPDDWDLYEVNEAFAISLWLPHHLLGIPYERMNVHGGAIAIGHPLGASGARIVVTLINALKTHNKSRGVATLCHGTGGGSTLAIEVF

SEQ ID NO: 297 - protein, 407 aa, Pyrobaculum oguniense
MNTNYLATSNLPSVEVVIVGYARTPIGKFGGGLKDVKTAHLAAFAIRKALDRAGVEGKFVDEVIIGSTLQGGQGQSLARQAALYAGLPVTTSAYTVNRVCSSGMQAVIEAYREIALGDADIVVAGGAESMSTAPLAFAPEVRWGVKHLIGRGQQLLDLMVYDGLTDPVNGLLMGEEAEMVAKEWGLTRQELDLVAYESHMRAWRATENKWFLDLEPIDDVLGGVRVKLDRDEGIRPDTTVEKLAKLKPAFKPDGVLTAGNSSQLSDGAAVLVLASADKAKELGLKPVAKVLGYSWHMVEPWRFIEAPIYAVQKLFKKLGMDASQFDYFENNEAFAVNNVLFHKALQVPYDKLNAFGGAIALGHPLGASGARIITTLISVLKVKGGRRGIAALCHGTGGGTALAVELI

SEQ ID NO: 298 - protein, 404 aa, Sulfolobus islandicus
MNECIFSMPESVYIASAVRTPIGKFGGTLKNLSPVDLGSIVIREALKRAYVEPSKVDIAIMGNVLRAGHGQDIARQCAIRAGIPYEIDGFSVDMVCSSGMMSIITASQMIKSGDADIIVAGGTESMSQAMFTIKSDIRWGVKMLMNRSIELIDTMLYDGLTDPFLQKVMGQEADMVAKAHNISRKELDEVAYQSHLRAHKATVNGYFKSEIVEIKTDGKVVNVDEGIRADTSLDKLSTLPPAFTDGGPHTAGNSSQISDGATALVLMSEKAIKELKIEPIARILGYSWVGIESWRFTEAPIFAIKKLLNKLNIDINHFDYFENNEAFAVNNVLVNRYLGIPYDRLNVFGGAIALGHPIGASGARIIVTLLNVLSKMRGARGIASICHGIGGSTAVAIELLREMK

SEQ ID NO: 299 - protein, 404 aa, Sulfolobus islandicus; identical to SEQ ID NO: 290

SEQ ID NO: 300 - protein, 392 aa, Sulfolobus acidocaldarius; identical to SEQ ID NO: 287

SEQ ID NO: 301 - protein, 396 aa, Metallosphaera yellowstonensis
MPEVYVVSAVRTPIGKFGGSLREVKPQELGALVIKEALERSGVKPEEVELVVMGNVLRAGHGQDLARQASLKAGIPWNVDGYCVDMVCSSGMMSISNAYQIIKSGDADLVVAGGMESMSQAMFALRADLRWGIKSLQGRNVEFIDTMLFDGLTDPFNLKLMGQEADMVAKERDISRRELDEVAYESHRRAARAWEKGFFSHETVPVSLPQGRLERDEGFRPDTSLEKLSSLKPAFSEGGLHTAGNSSQISDGATALVLMSEKAVRERRIEPIARIMGHSWVGIESWRFTEAPIQAVRKLLTKLGMELKDFDYFENNEAFAVNNVLMHRFLGVPYERLNVFGGAIALGHPIGASGARIVTTLINVLSRMKGERGIASICHGTGGSTAIGIELIKPLP

SEQ ID NO: 302 - protein, 395 aa, Thermoproteus tenax
MREVWIVGYARTPIGKFGGALRDVKTAHLAAFAIRKSLERVGLDGKLVDEVVIGSTLQGGQGQSLARQAALYAGLPVTTSAYTVNRVCSSGMQAVIEAYREIAVGDADIVIAGGAESMSTAPLAIPYDSRWGVKHLIGRQQALVDLMVYDGLTDPTNNMLMGEETDLLAREWGITRQELDQVAYESHMRAWRATENKWFLDMEPIEENLGGVPVRLDRDEGIRPDTSLEKLAKLKPAFRPDGVLTAGNSSQLSDGAAVLVLASAERARELGLRPVAKILGYSWHMVEPWRFVEAPIYAVQKLLKKLGVDITYFDYFENNEAFAVNNVLFHRVLQVSYEKLNPFGGAIALGHPLGASGARVITTLISVLKVKGAKRGIAALCHGTGGGTAIAIELA

SEQ ID NO: 303 - protein, 397 aa, Sulfolobus solfataricus; identical to SEQ ID NO: 283

SEQ ID NO: 304 - protein, 397 aa, Sulfolobus solfataricus; identical to SEQ ID NO: 283

SEQ ID NO: 305 - protein, 397 aa, Sulfolobus acidocaldarius
MPKLKQNVYIVDGVRTPVGKFGGAYKDIPAVDLASFTLKEVLERAGLKPSDLDMLIYGHVIRAGTGMDSARQVAIKSGVPYHIDSMTVDMVCASGMAAIITAANYIASGSYNVIAAGGMESMSMAPFIIQSSARWGMKHLIGREWQILDAMVYDGLWDVLLNKVMGEEADMTAAEYNAPRDELDRISYESHERAAKAWDGNLMKDFVVPYEKNGKVVLDHDEGIRRDTSIEKLKSLPYAFTSRGPHTAGSSSQLSDGAATLLIASEEAVKSLGLKPIARIVGFAYHGVETWRFPAAPVGAVKKLLDDVGWTIDMVDYWENNEAFAVNSYIMHKELGIPYDRMNVHGGAIAVGHPLGMSGARITLELINVLRRHGGKRGVASICHGLGGAASIAIELV

SEQ ID NO: 306 - DNA, 12 bp, Artificial
  consensus RIBOSOME BINDING SITE
tagtggaggata

SEQ ID NO: 307 - DNA, 14 bp, Artificial
  RIBOSOME BINDING SITE
ggtgatatgcaatg

SEQ ID NO: 308 - DNA, 16 bp, Artificial
  RIBOSOME BINDING SITE
ggaggtggagaaaatg

SEQ ID NO: 309 - DNA, 15 bp, Artificial
  RIBOSOME BINDING SITE
ggaggtttgaagatg

SEQ ID NO: 310 - DNA, 17 bp, Artificial
  RIBOSOME BINDING SITE
ggaggtgtgggaaaatg

SEQ ID NO: 311 - DNA, 19 bp, Artificial
  RIBOSOME BINDING SITE
ggagggggtgagagagatg

SEQ ID NO: 312 - DNA, 12 bp, Artificial
  transcription termination
aatcttttttag

SEQ ID NO: 313 - DNA, 12 bp, Artificial
  P. furiosus ribosomal binding site
ggaggtttgaag

SEQ ID NO: 314 - DNA, 14 bp, Artificial
  P. furiosus ribosomal binding site
gggaggtggagcat

SEQ ID NO: 315 - DNA, 11 bp, Artificial
  P. furiosus ribosomal binding site
ggtgatatgca

SEQ ID NO: 316 - DNA, 32 bp, Artificial
  PRIMER
gaatccccgcggcccgggctggcagaatagaa

SEQ ID NO: 317 - DNA, 53 bp, Artificial
  PRIMER
gcaaccaaaactctactaaagggtggcatttttctccacctcccaataatctg

SEQ ID NO: 318 - DNA, 25 bp, Artificial
  PRIMER
atgccaccctttagtagagttttgg

SEQ ID NO: 319 - DNA, 50 bp, Artificial
  PRIMER
gttgcagtcatcttcaaacctccttactttatcaccactaggatatctcc

SEQ ID NO: 320 - DNA, 51 bp, Artificial
  PRIMER
gtgataaagtaaggaggtttgaagatgactgcaacttttgaaaaaccggat

SEQ ID NO: 321 - DNA, 51 bp, Artificial
  PRIMER
cgttctcctcatatgctccacctcccttagaggggtatatttccatgcttc

SEQ ID NO: 322 - DNA, 49 bp, Artificial
  PRIMER
ccttttcagtcattgcatatcacctcatctcttgtctatgtagcccttc

SEQ ID NO: 323 - DNA, 53 bp, Artificial
  PRIMER
tagacaagagatgaggtgatatgcaatgactgaaaaggtatctgtagttggag

SEQ ID NO: 324 - DNA, 42 bp, Artificial
  PRIMER
ccaatgcatgcttatttttcccaaactagtttgtataccttc

SEQ ID NO: 325 - skipped

SEQ ID NO: 326 - DNA, 12 bp, Artificial
  Untranslated region
aatcttttttag

SEQ ID NO: 327 - DNA, 65 bp, Artificial
  homologous recombination region
ctaaaaaagattttatcttgagctccattctttcacctcctcgaaaatcttcttagcggcttccc

SEQ ID NO: 328 - DNA, 12 bp, Artificial
  terminator
aatcttttttag

SEQ ID NO: 329 - DNA, 17 bp, Artificial
  RIBOSOME BINDING SITE
gggaggtggagaaaatg

SEQ ID NO: 330 - DNA, 17 bp, Artificial
  RIBOSOME BINDING SITE
gggtgatgtggggatga

SEQ ID NO: 331 - DNA, 18 bp, Artificial
  RIBOSOME BINDING SITE
taaggaggtttgaagatg

SEQ ID NO: 332 - DNA, 20 bp, Artificial
  RIBOSOME BINDING SITE
taagggaggtggagcatatg

SEQ ID NO: 333 - DNA, 17 bp, Artificial
  RIBOSOME BINDING SITE
tgaggtgatatgcaatg

SEQ ID NO: 334 - DNA, 12 bp, Artificial
  terminator
aatcttttttag

SEQ ID NO: 335 - DNA, 65 bp, Artificial; identical to SEQ ID NO: 327
  3' end of the marker cassette

SEQ ID NO: 336 - DNA, 12 bp, Artificial
  RIBOSOME BINDING SITE
ggaggtttgaag

SEQ ID NO: 337 - DNA, 14 bp, Artificial
  RIBOSOME BINDING SITE
ggaggtggagaaaa

SEQ ID NO: 338 - DNA, 12 bp, Artificial
  terminator
aatcttttttag

SEQ ID NO: 339 - DNA, 12 bp, Artificial
  RIBOSOME BINDING SITE
ggaggtttgaag

SEQ ID NO: 340 - DNA, 14 bp, Artificial
  RIBOSOME BINDING SITE
ggaggtggagaaaa

SEQ ID NO: 341 - DNA, 11 bp, Artificial
  RIBOSOME BINDING SITE
ggtgatatgca

SEQ ID NO: 342 - DNA, 12 bp, Artificial
  terminator
aatcttttttag

SEQ ID NO: 343 - protein, 469 aa, Sulfolobus islandicus
MPRLPLLLLLLWGTGSHGFPAATSETQEQDVETVKKYLENYYNLNSNGKKVERQRNGGLITEKLKQMQKFFGLRVTGKPDAETLNVMKQPRCGVPDVAPFVLTPGKSCWENTNLTYRIENYTPDLSRADVDQAIEKAFQLWSNVTPLTFTKVSEGQADIMISFVRGDHRDNSPFDGPGGNLAHAFQPGAGIGGDAHFDDDEWWTSNFQDYNLYRVAAHEFGHSLGLAHSTDIGALMYPSYTFSGDVQLSQDDIDGIQAIYGPSQNPTQPVGPQTPEVCDSKLTFDAITTIRGEVMFFKDRFYMRTNPLYPEVELNFISVFWPQLPNGLQAAYEVADRDEVRFFKGNKYWAVKGQDVLRGYPRDIYRSFGFPRTVKSIDAAVSEEDTGKTYFFVANKCWRYDEYKQSMDAGYPKMIAEDFPGIGNKVDAVFQKGGFFYFFHGRRQYKFDPQTKRILTLLKANSWFNCRKN

SEQ ID NO: 344 - protein, 167 aa, Acidianus hospitalis
MKLYRVYSETGDTYLMAVESKGNVDKIKTEANEFEIEYLGKGTRDNEYLFKVNGEIHHVFVDNGYVFVDNASVFKLERATELPTKEGESVEEMIKGREGEVISPLQGRVVSIRVKEGDAVNKGQPLLSIEAMKSETIISAPVAGVVEKILVKQGQGVKKGDTLVIIK

SEQ ID NO: 345 - protein, 497 aa, Sulfolobus tokodaii
MVSYYEVVRSFSWKEIEKTIDISSLVDHEGVAVIRFSKEGKEQITFQELKDKALRLASYLKHIAGVKKGDVISVLASKKIEQVIVLLASLYIGALYQPLFTAFGPKAIEIRTRDKKPKVLFYQDDQKEKVSEGVPLSKLDELTSYGRLEEIERLSWNDPIILLYTSGSTGLPKGALISKRLLLNTYVYMKYGIGLRENDIFWNGADPGWAYGLYYGIIGPLLFGKTVIFLDEPFDAERTMEFLEENKITNFAWAPTTYRIISRSVKRKYDLRLERASSAGEPLNPEVIKWFKDNYNVIVKDHYGQTEVGMVVYNGWGYDYELKIGSMGLPAPGYEVDIIEENIAVKKTSPGFHFLGYLNNPEKTQEAFRGDWYLTGDVASKDQDGYFWFIGRKDDVTKVSGYRIGPFEVESVLLEHPAILESAVVADEDPIRGHVLHAYIVLKPGYTPSEELKKEIIEFVKSRYSKTVHLERVDFIDKLPKTESGKIQRYLLKKKIS

SEQ ID NO: 346 - protein, 544 aa, Sulfolobus tokodaii
MFEIDLRENRFHNYDELIKTFKWSIPSYFNIGEAILDRKIREGLGDNVAVYYEDEEGNHSVYTFSQLKKLSDSLITLLKENGVKKGDVIGVYLQPRVETIVSILTIYRLGGVTLSISPLMGVDAVEYRIKQSGAKVIIMEGSRKEVRERLKNVTKIVVDGEANRENEIEFDEVKKASGIYDAVNTGSEDPAQLFYTSGSTGAPKGVLHAHRFLLGHIPTYQLYFEMAPKEEDVFYTPADWGWIGAIGDVLLPSLYFGKPIVAYRRTGKFSPKDTLAVMQKYKVTCAFIPPTALRMIRREVSSPTKDYDLKLRAISSAGEAVGEELIEWAMKELSPNVNEFYGCTEANLVTVNNSLWRKIGSVGKPAPGHEVAVIDEQGNKLINQIGEIAVKSGDPVLFLGYYKNPEATAKKFRGDWFLIGDLGIMDEYGYIWFKGRADDVIKVSGYRLGPEEIESIILQHPAVQEVAVIGKADKLRGNIIKAFIVLKEGYSPSEELVTEIQQLVKSRLASYAYPREIEFVKELPRTETGKLKRFELRKREEEKS

SEQ ID NO: 347 - protein, 666 aa, Thermoproteus neutrophilus
MAQDTQELPFNEYIMNERWKSRQIDINAYKAFHAKSLEQLEEFWAHVAKELEWFRPWDKVLDASNPPFYRWFVGGRLNLSYLAVDRHVKTWRKNKLAIEWEGEPVDGNGEPTERRKLTYFDLYREVNRVAYMLKHNFGIKKGDRITLYMPMIPELPITMLAAWRIGAITSVVFSGFSAEALAERINDSQSRLVVTTDGFWRRGKVVRLKDVVDQALEKTRTVENVIVYSRLGLKDVPMTEGRDYWWHRVMEGIKVNAYVEPEPLESEHPSFILYTSGTTGKPKGIVHDTGGWAVHVYATMKWVFDLREEDVYWCTADVGWITGHSYVVLGPLLMGATQIIYEGAPDYPQPDRWWAVVERYGVTILYTSPTAIRMFMRYGEEWPRRHDLSTLRIINSVGEPINPEAWRWAYKVLGNENVAIASTWWMTETGGIVVSHAPGLYLIPMKPGTNGLPLPGFDVDVLDDNGKPAPPGVRGYLVIRRPWPGMLHGIWGDPDRYIKTYWSRFPGVFYVGDYAIKDQDGYIWVLGRADEVIKVAGHRLGTYELESALVSHPTVAEAAVVGVPDPIKGEVPIAYVVLKQGVVASDELRKELRDHVRKTIGPVAEPAHIFFVTKLPKTRSGKIMRRLLKAVATGAPLGDTTTLEDETSVEEAKKAYEELRREIARV

SEQ ID NO: 348 - protein, 646 aa, Acidianus hospitalis; identical to SEQ ID NO: 120

SEQ ID NO: 349 - protein, 498 aa, Sulfolobus islandicus; identical to SEQ ID NO: 268

SEQ ID NO: 350 - protein, 498 aa, Sulfolobus islandicus; identical to SEQ ID NO: 267

SEQ ID NO: 351 - protein, 583 aa, Vulcanisaeta moutnovskia
MSSSTFNEFLKQRNLLLNAGSYEEARSNFRWPPHGEFNWAVDYFDKYLAETSINPALIYINDELFKSGDSRILSYHELRARSNKLANALSDLGIGRGDVIMVMLNNKPELFESFLALMKTGAVISPATTLLLPSDIEDRTSRAHFKAIIADPEVVSRIDQIKGNLEKLGVKYFITLGKPGPGWLDYYELISGRSENFQGVKTKSDDLLLVYFTSGTTAKPKMVMHTQSSYPIGHLTTMYWVGAKPGYKHMNISSPGWAKWAWSTFFAAFNAGATTVVYDYSGRFSAANHLKILESYGIDTLCAPPTVWRMIILEDLTKYNLEKIKSFVSAGEPLNPEVIERVYKATGKYIRDGYGQTETTLMVGNFPGMKIKLGSMGKPAPGYDIVLVDEDGNPVSVNKDGHITVRTSPRPIGLMIGYDDENKNKEVFRLGLYFTGDVAFMDEEGYLYFVGRADDVFKSSDYRISPFELESDLLKHPAVAEAAVVPSPDPIRGFIPKAYIVLKPGYKPSKDLAYDIFKFIRLNIAPYKRPRAIEFVSELPKTISGKIRRVELRGIEREKRNKGVRSENEYFEDDFPDIKQLKV

SEQ ID NO: 352 - protein, 484 aa, Metallosphaera cuprina
MGREVKDVTKHPFLKPSVMSFKATFDAAWQEDTKELGRAWSPYLEDEINRFNHIHRSPEDLAAKVKLLRKLSHKTGACFQRCVGWDSLNTLHIVTTLMAKKGKTEPRERFVEYLKYVQKNDLALAGAMTDAKGVRNLKPSQQPNKNAYLRITEVTKDGIYVSGAKANITGVAATEEMVVLPTRAMGPEDKDYAVAFAIPTDTEGVKIVVGRQLNDARRMEEGEIDGLPYFYNHEGLVIFDNVFVPMNRVFLAGEWEYTGTLVEIFSAYHRQGYGGCKAGLGDVIIGASADLAKQIGVEKASHVQDKLTEMIFLTETMYSAGIAASLNAVKMCDNCWWVNPMHANVTKHLVARFPSQIAQLSIDLAGGIVGTAPSEWDLKNPKLKEYISRYLQGAEDFTAEDRLRMVRLVENVSMGVAFQIESVHGAGSPAAQRIMFSRLYDLNFAQEVAKSLAGRKSSVKFTPKAEPWRESQSETEAKEAGLKP

SEQ ID NO: 353 - protein, 498 aa, Metallosphaera yellowstonensis
MGLRTGDQYVEGLRRRKHVEVYVLGKLVEDVTTHPFLKPSVKAFKATFDAAFDEDTRALARVKSPFIGEEINRFVHIHQGPEDLVAKVKLLRKLSHKVGTCFQRCVGWDALNTMYIVTGKLAEREGKKVYFERFVEYLKYVQKNDLALAGAMTDVKGVRSLRPHEQPNKDAYVHVVEERGDGIVVRGAKANITGVAVVDEVVVMPTRAMTEKDAEYAVAFAIPLDTPGVKVVVGRQVNDLRRFEGEIDGLPYLFNHEGLVIFEDVFVPWERVFFYKEWKHSGELVEIFASFHRQGYAGCKSGLGDVIIGASFNLARQLGIADKPHVQEKLTEMVFLNETMYSAGLAASWEGRKLLKDGGWWVNPMFANITKHLVARFPYEIARLSHDIAGGIIATGPSEADLKNPDLRKLIEKYIQGVPEFTAEDRLRMVRLLENISLSAAYLVESVHGAGSPQAQRISIQRLYDLQKAEMIARRLAGMTNAQLDQKVEPHKPSDAER

SEQ ID NO: 354 - skipped

SEQ ID NO: 355 - protein, 514 aa, Acidianus hospitalis
MGIRTGQEYLDSIKVRNKVEIYVMGKEVKDVTTNPFLKPSVLAFKATFDSAWDEDTKDLARVWSPFINEEVNRFNHIHRSPEDLAAKVKLLRKISHKVGACFQRCVGYDALNTLYIITELMAQHGKTEPKEKFIEYLKTVQKKDLALAGAMTDAKGVRTLKPHEQPNKDAYVRITEVTKDGIYVSGAKANITGVAASEEIVVLPTRAMGPEDQDYAVAFSIPTDTEGIKIIVGRQLNDARRLEGGEIDALPYFYNHEGLIIFDNVFVPMERVFLMRDWQYTSQLVEIFSAYHRQGYGGCKAGLGDVIIGATYNLAKQIGVEKAPHVQDKINEEIFLTETMYAAGIAASLNGIEVCPGCWWVNPMQANVTKHLVTRFPSQIAQLAIDIAGGILGTAPSEWDLKNPKIKELLAKYLQGVEGYTAEDRIRMVRLLENVALGVAFQIESVHGAGSPAAQRIMFSRLYNLSYAEEVAKRLAGMKSNVKFTKKVEPWKESETEKLAKEAEKNTETASGGK

SEQ ID NO: 356 - protein, 540 aa, Sulfolobus solfataricus
MNKNLWIPILLIILGIGFLFHNLININLMFFVFPIIMIVVISFIFRNSLKVKINKFILKNGIFQIMYDNTCICGVAMKITGKIEPTSNKNDIEKELKDFINAIARKDSEFKFIIFTIVEKNKLGSSIIIYRILQHSTDIELDSFMEEVNNLLVLAKAIAPHLEFKIIQPSKNVLPIPMAFGNYPFLTVSEITYTNPINSNIVSEDFDVEIGEATNGTVTSRVGIRVKDITRHIGIFGSTGSGKTNTAILLASQLNAKGVKVIILDWHGEYDQLLKNGFRIYDEKTIVKINPLHLIDLDVEDTVDIIGDVLQLTDPQRFLLYTILLKLKSYRKFSINQLLEVINSIEDTSYWMRDVKYALLRKIFILFTPTASKLFSTVDETSLNDFPDYLTSSTIINLGFISNLKLRKLYSLFLIKLIVESYIRYKINQQTLIILDEAQNYFNREGNEFIDRLASEIRKYNIGLCFITQSPSLLSQNVLKNTNIKIIHSIKSDVDKKAIRDTLSLDERLTQSLDKLDVGEAIISAPNLKIPIIIKIKKIS

SEQ ID NO: 357 - protein, 502 aa, Sulfolobus solfataricus
MVLRTGEEYVNAIRHRNKVEIYVMGKEVKDVTEHPFLKPSVLAFKATYDAAHEEDSESLARAWSSFINEEVNRFTHIHRSPEDLAAKVKLLRKISHKTGACFQRCVGWDALNAIYVTSRLMAERGKKEYYERFVEYLKYVQKNDVALAGAMTDVKGIRTLRPHEQPHAYLRVTQVTKDGIYVSGAKANITGIGAAEEIVVMPTRAMSEKDMDFAVAFSIPLDTEGIKVIIGRQVNDGRRLEEGEIDGLPYRTNHEGLVIFDNVFVPMERVFMLGDWQMSGILVEIFSSYHRQGYGGCKSGLGDVIIGAAYNLAKQIGVEKAPHIQNKLNEMVLLNENMYGSGIAASLDAVKLCEDGCWWVNPMFANVTKQLVTRFPYEITKFSTDIAGGIIGTAPSEWDLKNPKLKPYIEKYLQGMMDYSTEDRLRMVRLLENVGFSVAFLIESVHGAGSPEAQRIAINRVYDYEYAEKIAKYLSQIEKRIDFKENAEPWRKTDTEKIASSG

SEQ ID NO: 358 - protein, 500 aa, Pyrobaculum aerophilum
MGLRTGDQYVEGLRKRKHVEIYVMGKRVEDVTAHPFLKPSVKSFKATFDAAFDEDTRGLARAYSPFIGEVVNRFVHIHQGPEDLVAKVKLLRKLSHKTGTCFQRCVGWDALNTLYIITGKIAEREGRREYVERFIEYLKYVQKNDLALAGAMTDVKGVRTLRPSEQPNKDAYVRVVEEREDGIVVRGAKANITGIAVVDEVIVMPTRAMTEKDAEYAISFAIPLDTPGVKVVVGRQLNDSRRFEEGEIDGLPYMFNHEGFLIFEDVFVPWERVFFYKEWRWSGVFVEVFSNYHRQGYAGCKSGLGDVIIGASYGLARRLGVADKPHIQEKLTEMAFLNETMYSAGLAASWEARKLLRDGGWWVNPMYANVTKHLVTRFPYEISRLAHDIAGGLLGTAPSEADFKNPELRPLLEKYLQGVPEFPAEERLRLLRLLENTSISVAYLIESVHGAGSPQAQRLSIQRVYDFQKVEQIASSLAGIKTAMAPDLKVEPHRQTDSEK

SEQ ID NO: 359 - protein, 502 aa, Sulfolobus tokodaii
MAIRTGEQYLDSIKIRNKAEIYVMGKEVKDVTTHPFLKPSVMAFKATFDAAWEEDTKELARAWSPFINEEVNRFNHIHRSPEDLAAKVKLLRKLSHKTGACFQRCVGWDALNTLWIMTNIMAQKGKKEYKDRFVEYLSYVQKKDLALAGAMTDAKGVRTLKPHQQPNKNAYVRIEEVTKDGIYVSGAKANITGVAATEEIVVLPTRAMGPEDKDYAVAFSIPTDTEGIKIIVGRQLNDARRLEGGDIDALPYFYNHEGLVIFDHVFVPMDRVFLMGEYEFTSQLVEVFSAYHRQGYGGCKAGLGDVIIGASMNLAKQLGVEKASHVQEKLTEMIFLTETMYSAGIAASLNAVKVCDNCWWVNPMHANVTKHLVARFPAQISQLSIDIAGGIIGTAPSEWDLKNPKLREYIAKYLQGVEGYTAEDRLRMVRLLENVSLGVAFQIESVHGAGSPAAQRIMFSRLYDLNYAEEVAKRLAGKKTDLQWKPKAEPWRESETEKLVKS

SEQ ID NO: 360 - protein, 506 aa, Metallosphaera yellowstonensis
MTVRTGEQYLESIRNRSKVEIYVMGKEVKDVTTHPFLRPSVMSFKATFDAAWQEDTKELGRAWSPFIEEEINRFNHIHRSPEDLAAKVKLLRKLSHKTGACFQRCVGWDSLNTLNIVSNMMAAKGKREMRDRFVEYLKFVQKRDLALAGAMTDAKGVRNLKPSQQPNKNAYLRITEVTKDGIYVSGAKANITGVAATEEMVVLPTRAMGPEDKDYAVAFALPTDTEGVKIVVGRQLNDSRRMEQGEIDALPYFYNHEGLVIFDNVFVPMNRVFLAGDWEYTGTLVEIFSAYHRQGYGGCKAGLGDVIIGASADLAKQIGVEKASHVQDKLTEMIFLTETMYSAGIAASLNAVKLCEGCWWVNPMHANVTKHLVAKFPAQIAQLSIDIAGGIVGTAPSEWDLKNPKLREYISKYLQGVEDYTAEDRLRMVRLIENVSMGVAFQIESVHGAGSPAAQRIMFSRLYDLNYSQEVAKSLAGRKSELKFTSKAEPWRESQSESEARESGLK

SEQ ID NO: 361 - protein, 500 aa, Pyrobaculum oguniense
MGLRTGQQYVEGIRHRQHASIYVMGKRVTDVTTNLFLKPSVLAFKATFDAAFEEDTRDLARVYSPIVGEEVNRFNSLHTSPQDLVAKVKLLRKLSHKTGTCFQRCVGWDALNTLYIVTRRMADKGKKIYYDNFIKYVADVQKKDLALAGAMTDVKGVRTLRPSEQPNPDAYVRVVEERDDGIIVRGAKANITGIAVVDEVVVMPTRAMSENDAAYAISFAIPLDSPGVKIVVGRQLNDARRLEGGEVDGLPYMFNHEGLLILDDVFVPWERVFLYKEWKEAGVLVEIFSSYHRQGYAGCKSGLGDVIIGATHNLAKQIGVVDKSHVQEKLTEMVFLNETMYSAGLAASWEGRKLVDGPGGFWVNPMYANVTKHLVTRFPYEIAKLSHDIAGGLLGTAPSEFDLKNPEIKALIEKYLQGVPEFTAETRLRMIRLLENTSLSVAYLVESVHGAGSPQAQRISMQRLYDVDAAEKIAKFLAGMGNRPVDFRVEPHKKSEAEKT

SEQ ID NO: 362 - protein, 505 aa, Sulfolobus acidocaldarius
MVIRTGDQYVSSISKRSKVEIYVLGKEVKDVTKHPFLKPSVMSFKATFDAAWDEDTKELGRAWSPYLEEEINRFNHIHRSPEDLAAKVKLLRKLSHKTGACFQRCVGWDSLNTLNIVTKIMANKGRTEPRDRFVEYLKYVQKNDLALAGAMTDVKGIRTLKPSQQPNKNAYLRVTEVTKDGIYVSGAKANITGVAATEEMVVLPTRAMGPEDKDYAVAFAIPTDTEGIKIVVGRQINDARRMEEGEIDGLPYFYNHEGLVIFDNVFVPMNRVFLAGEWEYTGTLVEIFAAYHRQGYGGCKAGLGDVIIGASADLARQIGVEKAPHVQDKLTEMIFLTETMYSAGIAASLNAVKICDNCWWVNPMHANVTKHLVARFPAQISQLAIDIAGGMVGTAPSEWDLKNPKLKEYIMRYLQGVEDFTAEDRLRMVRLIENVSMGVAFQIESIHGAGSPAAQRIMFSRLYDLDLAREISKKLAGRKADLKMTTKPEPWRETQSEQEAKEHDK

SEQ ID NO: 363 - protein, 505 aa, Sulfolobus acidocaldarius; identical to SEQ ID NO: 362

SEQ ID NO: 364 - protein, 503 aa, Pyrobaculum calidifontis
MSMGLRTGDQYVEGIKTRNKAKIYVLGKRVHDVTTNLFLKPSVLSFKATFDAAFEEDTRDLARVYSPFAGEEVNRFNSIHMGPQDLVAKVKLLRKLSHKTGTCFQRCVGWDALNTLYIVTKKLAEKEGKGIYYKNFIKYLEYVQRRDLALAGAMTDVKGVRPLKPSEQPNPDAYVRVVEERDDGIVVRGAKANITGIAVVDEVVVMPTRAMTEKDEVYAISFAIPLDTEGVTVVVGRQLNDARRLEEGEIDGLPYMFNHEGLLILEDVYVPWDRVFMYREWKWAGVLVEVFSAYHRQGYAGCKSGLGDVIIGAAYNLAKQIGVADKPHVREKLTEMVFLNETMYSAGLAASWEGKKLVEGDGGWWVNPMYANVTKHLVTRFPYEVSRLAHDIAGGLLGTAPSEFDLKNEEVGKLVAKYLQGVPEFTAEDRLRMLRLLENTSISVAYLVESVHGAGSPQAQRISMERIYDFYTVEKIAKSLARMGQRKADPRVEPHKPTDSEKA

SEQ ID NO: 365 - protein, 497 aa, Thermoproteus neutrophilus
MGLRTGDQYVEGLRNRKHVKVYVMGKRVEDVTTNLFMKPSLLSFKATFDAAFQEDTRDLARAYSPFINEEINRFVHIHQGPQDLVAKVKLLRALSHKTGSCFQRCVGWDGLNTMYIITGKLAEKGKPVYRERFLKYLEEVQRRDLALAGAMTDARGVRSLRPHEQPNPDAYVRVVEERDDGIIVRGAKANITGVALVDEVIVMPTRAMTEKDAPYAVAFAVPLDSPGVTVVVGRQINDVRKAEGDIDGLPYMSHHEGLIIFEDVFVPWDRVFLYQEWQWAGPLVEVFSAFHRQGYAGCKSGLGDVIIGAAYNLAKQIGVADKPNIVDKLTEMVFLNESMYSAGLAASWEGKKLLKDGGWWVNPMYANVTKHLVSRFPYEISRLSHDIAGGIIGTAPSEFDLKNSEIRQLVEKYLQGVPEFTAEDRLRMLRLLENVSVSVGFLIESVHGAGSPAAQKIVFSRLYDFQGAEAVAKRLARMRGPEPPGTPEPHKKSDVEK

SEQ ID NO: 366 - protein, 501 aa, Pyrobaculum ferrireducens
MGLRTGQQYVEGIKNRKHAKIYVMGKKVTDVTTNLFLKPSVESFKATFDAAFQEDTRDLARAYSPYIGEEVNRFVHIHQSPADLVAKVKLLRKLSHKTGTCFQRCVGWDALNTLYIVTHKIAAREGRAEYKERFMKYLEYVQRNDLALAGAMTDVKGVRTLRPSEQPNPDAYVRVVEQRDDGIVVRGAKANITGIAVVDEVIVLPTRAMTESDASYAVAFAVPLDTPGVTVVVGRQINDARRLEGGDLDGVPYMAHHEGLVIFEDVFVPWDRVFLYKDWRWTGPLVEIFASYHRQGYGGCKSGLGDVIIGATQGLARAIGIADKPAVAEKLAEMVFLNESMYSAGLAASWEGVKLLDDGGWWVNPMYANVTKHMVARFPYEVAKIAHDIAGGIVGTAPSEFDFKNEEIRHLIEKYLQGVPDIPTEERLRLVRLLENVSVSVGYLVESVHGAGSPAAQKIMFTRLYDFQKAEEIAKSLARVKVTVKWPKEPEPRRPSEAQKT

SEQ ID NO: 367 - protein, 505 aa, Sulfolobus islandicus
MVLRTGEEYVNAIRHRNKVEIYVMGKEVKDVTEHPFLKPSVLAFKATYDAAHEEDSKSLGRAWSSFINEEVNRFTHIHRSPEDLAAKVKLLRKISHKTGACFQRCVGWDALNTIYVTSRLMAEKGKKEYYERFVEYLKYVQKNDIALAGAMTDVKGVRTLRPNEQPHAYLRVTQVTKDGIYVSGAKANITGIAASEEIIVMPTRAMGEKDKDFAVAFSIPLDTERIKVIIGRQVNDGRRLEEGEIDGLPYRTNHEGLVIFDNVFVPMERVFMLGDWQMSGILVEIFSSYHRQGYGGCKSGLGDVIIGAAYNLAKQIGVEKAPHIQNKLNEMVLLNENMYGSGIAASLDAVKLCEDGCWWVNPMFANVTKQLVTRFPYEITKFSTDIAGGIIGTAPSEWDLKNPKLKPYIEKYLQGMMDYSTEDRLRMVRLLENIGFSVAFLIESVHGAGSPEAQRIAINRVYDYEYAEKIAKYLSQIEKRIEFKENAEPWRSTDTEKLANNGGQK

SEQ ID NO: 368 - protein, 505 aa, Sulfolobus islandicus
MVLRTGEEYVNAIRHRNKVEIYVMGKEVKDVTEHPFLKPSVLAFKATYDAAHEEDSKSLGRAWSSFINEEVNRFTHIHRSPEDLAVKVKLLRKISHKTGACFQRCVGWDALNTIYVTSRLMAEKGKKEYYERFVEYLKYVQKNDIALAGAMTDVKGVRTLRPNEQPHAYLRVTQVTKDGIYVSGAKANITGIAASEEIIVMPTRAMGEKDKDFAVAFSIPLDTESIKVIIGRQVNDGRRLEEGEIDGLPYRTNHEGLVIFDNVFVPMERVFMLGDWQMSGILVEIFSSYHRQGYGGCKSGLGDVIIGAAYNLAKQIGVEKAPHIQNKLNEMVLLNENMYGSGIAASLDAVKLCEDGCWWVNPMFANVTKQLVTRFPYEITKFSTDIAGGIIGTAPSEWDLKNPKLKPYIEKYLQGMMDYSTEDRLRMVRLLENIGFSVAFLIESVHGAGSPEAQRIAINRVYDYEYAEKIAKYLSQIEKRIEFKENAEPWRSTDTEKLANNGGQK

SEQ ID NO: 369 - protein, 505 aa, Sulfolobus islandicus
MVLRTGEEYVNAIRHRNKVEIYVMGKEVKDVTEHPFLKPSVLAFKATYDAAHEEDSKSLGRAWSSFINEEVNRFTHIHRSPEDLAAKVKLLRKISHKTGACFQRCVGWDALNTIYVTSRLMAEKGKKEYYERFIEYLKYVQKNDIALAGAMTDVKGVRTLRPNEQPHAYLRVTQVTKDGIYVSGAKANITGIAASEEIIVMPTRAMGEKDKDFAVAFSIPLDTESIKVIIGRQVNDGRRLEEGEIDGLPYRTNHEGLVIFDNVFVPMERVFMLGDWQMSGILVEIFSSYHRQGYGGCKSGLGDVIIGAAYNLAKQIGVEKAPHIQNKLNEMVLLNENMYGSGIAASLDAVKLCEDGCWWVNPMFANVTKQLVTRFPYEITKFSTDIAGGIIGTAPSEWDLKNPKLKPYIEKYLQGMMDYSTEDRLRMVRLLENIGFSVAFLIESVHGAGSPEAQRIAINRVYDYEYAEKIAKYLSQIEKRIEFKENAEPWRSTDTEKLANNGGQK

SEQ ID NO: 370 - protein, 498 aa, Pyrobaculum islandicum
MGLRTGEQYVEGLRNRRHVKVYVMGKRVEDVTTNLFLKPSLLSFKATFDAAFQEDTRDLARAYSPFINEEINRFVHIHQGPQDLVAKVKLLRALSHKTGTCFQRCVGWDALNTLYIITGKMAEKGKPIYRERFFQYLEEVQRRDLALAGAMTDARGVRSLRPHEQPNPDAYVRVVEERDDGIIVRGAKANITGVALVDEVIVMPTRAMTEKDAPYAVAFAVPLDSPGVTVVVGRQINDVRKAEGDIDGLPYMSHHEGLIIFEDVFVPWDRVFLYQEWQWAGPLVEVFSAFHRQGYAGCKSGLGDVIIGAAYNLAKQIGVADKPNIVDKLTEMVFLNESMYSAGLAASWEGKKLLKDGGWWVNPMYANVTKHLVSRFPYEIARLAHDIAGGIIGTAPSEFDLKNSEIKHLVEKYLQGVPEFTAEDRLRMLRLLENVSISVGFLIESVHGAGSPAAQKIVFSRLYDFQGAETIARRLARMRGPEPPGASELHRKSEIEKL

SEQ ID NO: 371 - protein, 505 aa, Sulfolobus islandicus
MVLRTGEEYVNAIRHRNKVEIYVMGKEVKDVTEHPFLKPSVLAFKATYDAAHEEDSKSLGRAWSSFINEDVNRFTHIHRSPEDLAAKVKLLRKISHKTGACFQRCVGWDALNTIYVTSRLMAERGKKEYYERFVEYLKYVQKNDIALAGAMTDVKGVRTLRPNEQPHAYLRVTQVTKDGIYVSGAKANITGIAASEEIIVMPTRAMGEKDKDFAVAFSIPLDTESIKVIIGRQVNDGRRLEEGEIDGLPYRTNHEGLVIFDNVFVPMERVFMLGDWQMSGILVEIFSSYHRQGYGGCKSGLGDVIIGAAYNLAKQIGVEKAPHIQNKLNEMVLLNENMYGSGIAASLDAVKLCEDGCWWVNPMFANVTKQLVTRFPYEITKFSTDIAGGIIGTAPSEWDLKNPKLKPYIEKYLQGMMDYSTEDRLRMVRLLENIGFSVAFLIESVHGAGSPEAQRIAINRVYDYEYAEKIAKYLSQIEKRIEFKENAEPWRSTDTEKLANNGGQK

SEQ ID NO: 372 - protein, 505 aa, Sulfolobus islandicus
MVLRTGEEYVNAIRHRNKVEIYVMGKEVKDVTEHPFLKPSVLAFKATYDAAHEEDSKSLGRAWSSFINEEVNRFTHIHRSPEDLAVKVKLLRKISHKTGACFQRCVGWDALNTIYVTSRLMAEKGKKEYYERFVEYLKYVQKNDIALAGAMTDVKGVRTLRPNEQPHAYLRVTQVTKDGIYVSGAKANITGIAASEEIIVMPTRAMGEKDKDFAVAFSIPLDTESIKVIIGRQVNDGRRLEEGEIDGLPYRTNHEGLVIFDNVFVPMERVFMLGDWQMSGILVEIFSSYHRQGYGGCKSGLGDVIIGAAYNLAKQIGVEKAPHIQNKLNEMVLLNENMYGSGIAASLDAVKLCEDGCWWVNPMFANVTKQLVTRFPYEITKFSTDIAGGIIGTAPSEWDLKNPKLKPYIEKYLQGMMDYSTEDRLRMVRLLENIGFSVAFLIESVHGAGSPEAQRIAINRVYDYEYAEKIAKYLSQTEKRIEFKENAEPWRSTDTEKLANNGGQK

SEQ ID NO: 373 - protein, 512 aa, Ignicoccus hospitalis
MGLRKPEEYISALREKSKRAEIYVLGERVEDVTKHPFTLPAVKAFEWTYKAPWDPYFYDKEMGVHLAKAYSPFINEEINRFNHIHQSPQDLAIKVKYFRKLSHKAGSCFQRCVGWDAINTISIISYDIDKWYEQKGEKPEHFEHFGTYYERFLKFLKYVQKEDIALAGVMTDAKGVRSLRPHEQPNKDVYVHVKEVADEGIIVRGAKANITGVVASEEMIVMPTRAMTEKDKDFAIAFAAPIDAEGVTLVVGRYTNDTRRFEEPNVDALPGVFPAEAIVIFDDVFVPWERVFMFREYQFAAELVEIFSSYHRQAYGGCKPGLADVIIGGAYHLAKQMGIANKCHIREKLTEMIFLTEAMHAGGLAAAWEGKKAASGTYYVDQMKANVTKQMVTRFPYEIARLAHDIAGGLIGTLPSYKDLMHEKIGKYLQQYLQCLPDYPAEWRHRVLRLLENITLSVEFLIESVHGAGSPEAQRIWMRRFYPLEEMEDVALSLAGINPEEKPERKKQKEQT

SEQ ID NO: 374 - protein, 505 aa, Sulfolobus islandicus
MVLRTGEEYVNAIRHRNKVEIYVMGKEVKDVTEHPFLKPSVLAFKATYDAAHEEDSKSLGRAWSSFINEEVNRFTHIHRSPEDLAVKVKLLRKISHKTGACFQRCVGWDALNTIYVTSRLMAERGKKEYYERFVEYLKYVQKNDIALAGAMTDVKGVRTLRPNEQPHAYLRVTQVTKDGIYVSGAKANITGIAASEEIIVMPTRAMGEKDKDFAVAFSIPLDTESIKVIIGRQVNDGRRLEEGEIDGLPYRTNHEGLVIFDNVFVPMERVFMLGDWQMSGILVEIFSSYHRQGYGGCKSGLGDVIIGAAYNLAKQIGVEKAPHIQNKLNEMVLLNENMYGSGIAASLDAVKLCEDGCWWVNPMFANVTKQLVTRFPYEITKFSTDIAGGIIGTAPSEWDLKNPKLKPYIEKYLQGMMDYSTEDRLRMVRLLENIGFSVAFLIESVHGAGSPEAQRIAINRVYDYEYAEKIAKYLSQIEKRIEFKENAEPWRSTDTEKLANNGGQK

SEQ ID NO: 375 - protein, 505 aa, Sulfolobus islandicus
MVLRTGEEYVNAIRHRNKVEIYVMGKEVKDVTEHPFLKPSVLAFKATYDAAHEEDSKSLGRAWSSFINEEVNRFTHIHRYPEDLAVKVKLLRKISHKTGACFQRCVGWDALNTIYVTSRLMAERGKKEYYERFVEYLKYVQKNDIALAGAMTDVKGVRTLRPNEQPHAYLRVTQVTKDGIYVSGAKANITGIAASEEIIVMPTRAMGEKDKDFAVAFSIPLDTESIKVIIGRQVNDGRRLEEGEIDGLPYRTNHEGLVIFDNVFVPMERVFMLGDWQMSGILVEIFSSYHRQGYGGCKSGLGDVIIGAAYNLAKQIGVEKAPHIQNKLNEMVLLNENMYGSGIAASLDAVKLCEDGCWWVNPMFANVTKQLVTRFPYEITKFSTDIAGGIIGTAPSEWDLKNPKLKPYIEKYLQGMMDYSTEDRLRMVRLLENIGFSVAFLIESVHGAGSPEAQRIAINRVYDYEYAEKIAKYLSQIEKRIEFKENAEPWRSTDTEKLANNGGQK

SEQ ID NO: 376 - protein, 505 aa, Sulfolobus islandicus
MVLRTGEEYVNAIRHRNKVEIYVMGKEVKDVTEHPFLKPSVLAFKATYDAAHEEDSKSLGRAWSSFINEEVNRFTHIHRSPEDLAAKVKLLRKISHKTGACFQRCVGWDALNTIYVTSRLMAEKGKKEYYERFVEYLKYVQKNDIALAGAMTDVKGVRTLRPNEQPHAYLRVTQVTKDGIYVSGAKANITGIAASEEIIVMPTRAMGEKDKDFAVAFSIPLDTESIKVIIGRQVNDGRRLEEGEIDGLPYRTNHEGLVIFDNVFVPMERVFMLGDWQMSGILVEIFSSYHRQGYGGCKSGLGDVIIGAAYNLAKQIGVEKAPHIQNKLNEMVLLNENMYGSGIAASLDAVKLCEDGCWWVNPMFANVTKQLVTRFPYEITKFSTDIAGGIIGTAPSEWDLKNPKLKPYIEKYLQGMMDYSTEDRLRMVRLLENIGFSVAFLIESVHGAGSPEAQRIAINRVYDYEYAEKIAKYLSQTEKRIEFKENAEPWRSTDTEKLANNGGQK

SEQ ID NO: 377 - protein, 502 aa, Sulfolobus solfataricus; identical to SEQ ID NO: 357

SEQ ID NO: 378 - protein, 505 aa, Sulfolobus islandicus
MVLRTGEEYVNAIRHRNKVEIYVMGKEVKDVTEHPFLKPSVLAFKATYDAAHEEDSKSLGRAWSSFINEEVNRFTHIHRSPEDLAAKVKLLRKISHKTGACFQRCVGWDALNTIYVTSRLMAEKGKKEYYERFVEYLKYVQKNDIALAGAMTDVKGIRTLRPNEQPHAYLRVTQVTKDGIYVSGAKANITGIAASEEIIVMPTRAMGEKDKDFAVAFSIPLDTESIKVIIGRQVNDGRRLEEGEIDGLPYRTNHEGLVIFDNVFVPMERVFMLGDWQMSGILVEIFSSYHRQGYGGCKSGLGDVIIGAAYNLAKQIGVEKAPHIQNKLNEMVLLNENMYGSGIAASLDAVKLCEDGCWWVNPMFANVTKQLVTRFPYEITKFSTDIAGGIIGTAPSEWDLKNPKLKPYIEKYLQGMMDYSTEDRLRMVRLLENIGFSVAFLIESVHGAGSPEAQRIAINRVYDYEYAEKIAKYLSQIEKRIEFKENAEPWRSTDTEKLANNGGQK

SEQ ID NO: 379 - protein, 651 aa, Metallosphaera yellowstonensis
MKVAVIGSGVMGHGIAELFAMAGHEVWINDVSEEILKSALQRIRWSLEKLAERGSLKENVDSVMSRIRSSVDQAQALKGSDFVIEAVKEDLELKRTIFRNAEAHASPSAVLATNTSSLPITEISQGLSHPERVAGMHFFNPPVLMPLVEIVRGEETSEDTVRKVADLSKQLGKEFIVVRDVPGFFVNRILLRIMEAGCFLVDKGFASVEEVDSTSMEELGFPMGVFLLADYTGLDVGASVWNAVIKRGFEAYPCRKVQELVSQGHLGVKSGRGFYSYPQPGKFTRPQLPSAKPGISHFILAPAVNEVASLIRQGIVSVEDSEKGCQLGLGLPKGMLRYADEIGLDKVMSALEEMKRLTGMGHFSPDPSLITLISQGKLGRKTGEGFYKYEARERTFTTIYVKREPPVAWIVLNRPSRYNALNWDMVKELSEALDELEEDPEIRVIAVKGEGKAFCAGADVQEFLSLTPVKAMMVSRKFHEVFFKIQFLTKPVVAAINGVALGGGFELAMACDVRIASKIAEMGQPEVNLGLIPGGGGTFRLPRLAKRRGLELVITGERLKAQEALELGLVDKVVEHESLEDEVTKFAETVSSRPPLAVALGKMAVNTGRETNSWVSSAYEASLFGLLFSTSDFKEGVRAFLERRRPEFKGV

SEQ ID NO: 380 - protein, 672 aa, Sulfolobus acidocaldarius
MVSANDVKQVLVVGAGTMGHGIAEVFAIAGYNVFLADVNRQILDSAMDKIRWSLSKLAEKGQLKESVDSVMSRITAVISVNPDGSFSNDLAAVASQADMMIEAITEKLDAKQALFRFVDQHRKGKIIMATNTSSLPITEIASATSSPELVVGMHFFNPPPLMPLIEIIKGERTSDDVVQSVVDLAKRIGKQPVVVNKDVPGFIVNRILARFLNTACWLVAKGRASVLEVDSTVRFSLGFPMGAFELADYSGIDVFYLIAVAMTQRGFKQTPCPLFEQMYKANTLGMKTGKGFYEYPKPGAYVRPQIPKDLAGKVDPVTLIASAVNEAAWLLENGIATKEDIDKAVKLGLGWPKGVFELADQYGIDSIVATLNQLKQDIGPEYSPEPLLTQMVSQGTLGVKTGKGFYEYGHYEEVAKSTLIVRYEKPIAWIILNRPNKLNAINVDMINELSQTLDEIEQNPDVRVVILTGSGRAFSAGADITGFAGITPIQAAIFSRKFQELTLKMEYYTKPIIVAINGYTLGGGLEIAMSGDIRIAAETAMLGQPEINLGFIPGAGGTQRLPRLVGRSSAKLLIFTGDMVSAKDAKELGLVDYVVPPERLEQEARSLALKLAEKPPLALLAAKLAVEMGLESNIWAGLALESQLFGLLFSTKDVVEGVSAFLEKRKPLFKGE

SEQ ID NO: 381 - protein, 662 aa, Pyrobaculum aerophilum
MPKVAVIGAGTMGHGIAELFAIAGYEVALVDVAEDFLKRALQNIEWSLKKLAEKGQIKEDVGVILGRIKPIVNDVCKAVEGAELMVEAVVEDIEIKRKVFAEADRCAPPSAILATNTSSLPITEIAEAVKPERRPLVVGMHFFNPPVLMPLVEIIKGAYTSDETVKKTAEYASKLGKQTVVVNKDVPGFIVNRILARLNEAACWMVARGEATIQEVDSALIYKAGLPMGAFILMDYTGIDVVCFIGDAMVKRGFKTHPCPVIAEKCKEKKYGVKSGEGFYKYPAPGKFQWPEVPKAAGDKVDVTYLLAPAINEAAYLLRESIASREDIDKAIRLGLNWPKGPLEYADELGIDTVVKALEEWKNKTGFEEYEPDPLLRDMAAKGKLGKKSGEGFYTYVKAEEKKLETLIVRYEPGIAWIILNRPERLNAINPKMIEELWKVLDEIEQMDYDKVRVVVITGSGRAFSAGADVTGFMGATPVTIFKVSRKLQMLYERLELLDRPVICGLNGYTLGGGLELAMACDFRIAAETAELGQPEINLGFIPGAGGTQRLARLIGRDKAKELIFTGDRIPAREAERLGLVHKVVPPDRLEQELRAFANKLAEKPPLALAMAKYAINFGLEAPQWVGMMLEASNFGLLFSTEDVIEGVSAFLQKRKPQFKGK

SEQ ID NO: 382 - protein, 663 aa, Sulfolobus islandicus
MKVEDIKKVLVVGAGTMGHGIAEIAAISGYKVYLSDISQDILNSALERIRWSLSKLRERGQIKESIDTIMSRITTILGLDKTVSDADFSIEASTERIDIKRQVFSKLDELLPSHAILATNTSSLPITKIAEATKRPDKVVGMHFFNPPVLMQLVEVMKGDKTSDETAKITYDLAKRFGKQPIMINKDVPGYVVNRILGQINVASCILVEKKVADYREVDSVARYKLGFPMGVYELIDYTGVDVAYYVSKSREELGIRDDIPICSLIEQKFKNNELGVKTGKGFYTYPGPGKYVKPELPKELADKLNPVLILAGAVNEAARLLREGIASRDDIDLGVRLGLGLPKGIFQYADELGIDSVVKALEDLKALSGYSVFSPDPLLTQMVGENKLGIKTGSGFYTYGKVEEKKLNTLIIRIEPPLAWIILNRPERLNALNPELVSELDKSLDELEGRNDVRVVIITGNGRAFSAGADVSSFITLRPIDVIRLRTLRNVVNKIALYTKPIIAGINGFALGGGLELAMACDIRIASEVAQLGQPEINIGIIPGAGGTQRLPKLVGKGKAKLMIYTGDMVSAEDAYKMGLVDLVAPANRFEEEVRRVALKIAEKSPISLLAAKLAIELGYESNIWIGQTLESTLFGLLFTTKDVEEGVKAFLEKRKPQFKGE

SEQ ID NO: 383 - protein, 663 aa, Sulfolobus islandicus
MKVEDIKKVLVVGAGTMGHGIAEIAAISGYKVYLSDISQDILNSALERIRWSLSKLQERGQIKESIDTIMSRITTIVGLDKTVSDADFSIEASTERMDIKRQVFSKLDELLPSHAILATNTSSLPITKIAEATKRPDKVVGMHFFNPPVLMQLVEVMKGDKTSDETAKITYDLAKRFGKQPIMINKDVPGYVVNRILGQINVASCILVEKKVADYREVDAVARYKLGFPMGVYELIDYTGVDVAYYVSKSREELGIRDDIPICSLIEQKFKNNELGVKTGKGFYTYPGPGKYVKPELPKELADKLNPVLILAGAVNEAARLLREGIASRDDIDLGVRLGLGLPKGIFQYADELGIDSVVKALEDLKALSGYSVFSPDPLLTQMVGENKLGIKSGSGFYTYGKVEEKKLNTLIIRIEPPLAWIILNRPERLNALNTELVSELDKSLDELEGRSDVRVVIITGNGRAFSAGADVSSFITLRPIDVIRLRTLRNVVNKIALYTKPIIAGINGFALGGGLELAMACDIRIASEVAQLGQPEINIGIIPGAGGTQRLPRLVGKGKAKLMIYTGDMVSAEDAYKMGLVDLVAPANRFEEEVRRVALKIAEKSPISLLAAKLAIELGYESNIWTGQTLESTLFGLLFTTKDVEEGVKAFLEKRKPQFKGE

SEQ ID NO: 384 - protein, 663 aa, Sulfolobus islandicus
MKVEDIKKVLVVGAGTMGHGIAEIAAISGYKVYLSDISQDILNSALERIRWSLSKLQERGQIKESIDTIMSRITTIVGLDKTVSDADFSIEASTERMDIKRQVFSKLDELLPSHAILATNTSSLPITKIAEATKRPDKVVGMHFFNPPVLMQLVEVMKGDKTSDETAKITYDLAKRFGKQPIMINKDVPGYVVNRILGQINIASCILVEKKVADYREVDAVARYKLGFPMGVYELIDYTGVDVAYYVSKSREELGIRDDIPICSLIEQKFKNNELGVKTGKGFYTYPGPGKYVKPELPKELADKLNPVLILAGAVNEAARLLREGIASRDDIDLGVRLGLGLPKGIFQYADELGIDSVVKALEDLKALSGYSVFSPDPLLTQMVGENKLGIKTGSGFYTYGKVEEKKLNTLIIRIEPPLAWIILNRPERLNALNPELVSELDKSLDELEGRSDVRVVIITGNGRAFSAGADISSFITLRPIDVIRLRTLRNIVNKIALYTKPIIAGINGFALGGGLELAMACDIRIASEVAQLGQPEINIGIIPGAGGTQRLPKLVGKGKAKLMIYTGDMVSAEDAYKMGLVDLVAPANRFEEEVRRVALKIAEKSPISLLAAKLAIELGYESNIWTGQTLESTLFGLLFTTKDVEEGVKAFLEKRKPQFKGE

SEQ ID NO: 385 - protein, 661 aa, Thermoproteus neutrophilus
MGKVAVIGAGTMGHGIAELFAIAGYEVALVDVAEEYLKRALQNIEWSLRKLVEKGQVREDVQTVMSRIKTVVNDVCKAVEGAELMVEAVVENLEIKRKVFAEADRCAPPDAVLATNTSSLPITEIAEAVKPERRGRVVGMHFFNPPPLMPLVEIVRGAHTSDDTVKKVADYAAKLGKQTVVVNKDVPGFIVNRIFMRVNEAACWTAARGEATIQEVDAALIYKAGLPMGAFVLMDYTGLDVVCFIADSMAKRGYRSRPCPLLQELCQGKKYGVKTGEGFYRYPAPGKYEKPALPKEAAERVDPVDLLAPAINEAAYLLREGIATREDIDKAVRLGLNWPKGPLEYADEVGIDAVVKALERWRQRGFEEYAPDPLLAELAAGGKLGKKTGEGFYKYVKAEERRLETIVVRFEPGVAWIVLNRPDRLNAISPKMVEELWRTLDEIEQMDYDKVRVVVITGSGRAFSAGADVSGFAGASPIAMFKLSRRLQMLADRIELLDRPVICGINGYALGGGLELAMACDIRIAAETAELGQPEVNLGFIPGAGGTQRLARLIGRDRAKELIMTGERIPAREAERLGLVNRVVPPDRLEQELRAVANKLAEKPPLALAMAKYAVNFGVEIPLWAAEVLEAAEFGLLFSTKDVAEGVAAFLQKRKPQFRGH

SEQ ID NO: 386 - protein, 663 aa, Sulfolobus islandicus; identical to SEQ ID NO: 384

SEQ ID NO: 387 - protein, 663 aa, Sulfolobus islandicus
MKVEDIKKVLVVGAGTMGHGIAEIAAISGYKVYLSDISQDILNSALERIRWSLSKLQERGQIKESIDTIMSRITTIVGLDKTVSDADFSIEASTERMDIKRQVFSKLDELLPSHAILATNTSSLPITKIAEATKRPDKVVGMHFFNPPVLMQLVEVMKGDKTSDETAKITYDLAKRFGKQPIMINKDVPGYVVNRILGQINIASCILVEKKVADYREVDAVARYKLGFPMGVYELIDYTGVDVAYYVSKSREELGIRDDIPICSLIEQKFKNNELGVKTGKGFYTYPGPGKYVKPELPKELADKLNPVLILAGAVNEAARLLREGIASRDDIDLGVRLGLGLPKGIFQYADELGIDSVVKALEDLKALSGYSVFSPDPLLTQMVGENKLGIKSGSGFYTYGKVEEKKLNTLIIRIEPPLAWIILNRPERLNALNPELVSELDKSLDELEGRSDVRVVIITGNGRAFSAGADVSSFITLRPIDVIRLRTLRNVVNKIALYTKPIIAGINGFALGGGLELAMACDIRIASEVAQLGQPEINIGIIPGAGGTQRLPRLVGKGKAKLMIYTGDMVSAEDAYKMGLVDLVAPANRFEEEVRRVALKIAEKSPISLLAAKLAIELGYESNIWTGQTLESTLFGLLFTTKDVEEGVKAFLEKRKPQFKGE

SEQ ID NO: 388 - protein, 663 aa, Sulfolobus islandicus
MKVEDIKKVLVVGAGTMGHGIAEIAAISGYKVYLSDISQDILNSALERIRWSLSKLQERGQIKESIDTIMSRITTIVGLDKTVSDADFSIEASTERMDIKRQVFSKLDELLPSHAILATNTSSLPITKIAEATKRPDKVVGMHFFNPPVLMQLVEVMKGDKTSDETAKITYDLAKRFGKQPIMINKDVPGYVVNRILGQINIASCILVEKKVADYREVDAVARYKLGFPMGVYELIDYTGVDVAYYVSKSREELGIRDDIPICSLIEQKFKNNELGVKTGKGFYTYPGPGKYVKPELPKELADKLNPVLILAGAVNEAARLLREGIASRDDIDLGVRLGLGLPKGIFQYADELGIDSVVKALEDLKALSGYSVFSPDPLLTQMVGENKLGIKSGSGFYTYGKVEEKKLNTLIIRIEPPLAWIILNRPERLNALNPELVSELDKSLDELEGRSDVRVVIITGNGRAFSAGADVSSFITLRPIDVIRLRTLRNVVNKIALYTKPIIAGINGFALGGGLELAMACDIRIASEVAQLGQPEINIGIIPGAGGTQRLPRLVGKGKAKLMIYTGDMVSAEDAYKMGLVDLVAPTNRFEEEVRRVALKIAEKSPISLLAAKLAIELGYESNIWTGQTLESTLFGLLFTTKDVEEGVKAFLEKRKPQFKGE

SEQ ID NO: 389 - protein, 663 aa, Sulfolobus solfataricus
MKVEDIKKILVVGAGTMGHGIAEIAAISGYKVYLSDISQDILNNALERIRWSLSKLQERGQIKESVDTIMSRITTIVGLDKTVSDADFSIEASTERMDIKRQVFSKLDELLPPHAILATNTSSLPISKIAEATKRQDKVVGMHFFNPPVLMQLVEVMKGDKTSDETAKITYDLAKKFGKQPIMINKDVPGYVVNRILGQINIASCILVEKKVADYREVDAVARYKLGFPMGVFELIDYTGVDVAYYVSKSREELGIRDDIPICSLIEQKFKNNELGVKTGKGFYTYPAPGKYVKPELPKELADKLNPALILAGGVNEATRLLREGIASRDDIDLGVRLGLGLPKGIFQYADELGVDTVLKALEDLKALSGYNTFNPDPMITQMIRENKLGIKTGSGFYQYGKVEEKKMNTLIIRIEPPLAWIILNRPERLNALNPELVSELDKSLDELESRSDVRVVIITGNGRAFSAGADVSSFITLRPIDVIRLRTLRNVVNKIALYTKPIIAGINGFALGGGLELAMACDIRIASEVAQLGQPEINIGIIPGAGGTQRLPRLVGKGKAKLMIYTGDMVSAEDAYKMGLVDLVVPSNRFEEEVRRVALKIAEKSPISLLAAKLAIELGYESNIWTGQTLESTLFGLLFTTKDVEEGVKAFLEKRKPQFKGE

SEQ ID NO: 390 - protein, 662 aa, Pyrobaculum islandicum
MPKVAVIGAGTMGHGIAELFAMAGYEVALVDVADEYLKRALQNIEWSLKKLAEKGQLKEDPSAVLSRIRPVVGDVCSAVVGVELMVEAVVEDIEVKKRVFAEADRCAPPEAILATNTSSLPITEIAEAVKPERKTKVVGMHFFNPPVLMPLVEVIKGQYTSDETVKKVAEYAQKLGKQTVVVNRDVPGFIVNRILARVNEAACWMVARGEATIQEVDSALIYKAGLPMGAFILMDYTGIDVICFIGDAMLKRGFKSHPCPLILEKCQQKKYGVKSGEGFYKYPAPGKFQWPEVPKSAGDRIDIVYILAPAINEAAYLLREGIATREDIDKAVRLGLNWPKGPLEYADEIGIDTIVKTLEEWRQKTGFEEYEPDPLLKEMAAKGKLGKKTGEGFYTYVKAEEKKLETLIVRYEPGIAWIILNRPERLNAINPKMIEELWKVLDEIEQMDYDKVRVVIITGAGRAFSAGADVTSFMGATPITIFKISRKLQMLFERIELLDRPVICGLNGYTLGGGLELAMSCDFRIAAETAELGQPEINLGFIPGAGGTQRLPRLIGRDRAKELIFTGDRIPAREAERLGLVNKVVPPDKLEQELRAFANKLAEKPPLALAMAKYAINFGIEVPIWAATLLEATQFGILFSTEDVIEGVSSFLQKKKPQFKGR

SEQ ID NO: 391 - protein, 662 aa, Pyrobaculum arsenaticum
MPKIAVIGAGTMGHGIAELFAIAGYEVALVDIAEDFLKKALQNIEWSLRKLAEKGQVKEDPSVILSRIKPIVNDVCKAVEGAELMVEAAVENIDVKKKVFSEADRCAPPNAILATNTSSLPITEIAEAVRPERKPLVVGMHFFNPPVLMPLVEIIKGAYTSDETVKKIADYAAKLGKQTVVVNKDVPGFIVNRILARVNEAACWMVARGEATIQEVDSALMYKAGLPMGAFILMDYTGIDVVCFIGDAMLKRGFKSHPCPVITQKCQEKKFGVKSGEGFYKYPAPGKFQWPEVPKSAGDKIDVTYLLAPAVNEAAYLLREGIATREDIDKAVKLGLNWPKGPLEFADELGIDAVVKALETWRQKTGYEEYEPDPLLKEMVSQGKTGKKAGEGFYTYVKAEEKKLETLIVRYEPGVAWIILNRPERLNAINPKMVEELWRVLDEIEQMDYEKVRVVVITGAGRAFSAGADVTGFMGATPVTIFKVSRKLQMLYERLELLDRPVICGLNGYTLGGGLELAMACDFRIAAETAELGQPEINLGFIPGAGGTQRLARLIGRDRAKELIFTGDRIPAREAERLGLVHKVVSPDKLEQELRAFAAKLAEKPPLALAMAKYAINFGLEAPQWVGMMLEATQFGLLFSTEDVIEGVSSFLQKKKPQFKGR

SEQ ID NO: 392 - protein, 683 aa, Ignicoccus hospitalis
MGGALALYSLLRLWTADQALQEVRKVLVVGAGVMGHGIAQVAAMSGLNVRMIDIKQEFLDRAMERIKESLEKLYAKGKLKEPPEEVLKRIETMVANPDDESSYAEAAKDVDFVIEAVPEKLELKRAVFSVLDKYAPPHAILASNTSSIPITEIAKATKRPDKVVGMHFFNPPVILKLVEVVRGKETSDETVKITVELAKKMGKVPIVVNKDVPGFIVNRIMARFLNEGCWLVERGVYTKEQVDAALRYKLNFPMGAFELADYVGLDVLVHLMEAMKERGMNLTICPLFKKLLEEGKLGVKSGEGFYKYPAPGKFKKPVVKASAAEGVDYISIVDTAVNEGAWLVENGVAGPEEVDTATVLGLNLPMGILKLGDSLGLDNVLDSINEKKEKYGLEDYRPVQLLENMVKEGKCGVKCGKGFYEYEVSEEDLGEIKVRREGEALWIILNRPKQRNALTPEMLLKMAEVAQKACEDEGVRAIVLYGGDVFSAGFDLTVMKDVDPTKAPETVARPFKKLALALEGCPKPVIAYITGYALGGGLEVAMMADLRLATEDSLLGQPEINVGIMPGGGGTQRLPRLVGLGRAMQLVLLGDPIDAVEAEKWGLVNWAVPKRIADSEVRLLVKKLSSKPKEALALAKKAVRVAQEVPLIDGLEMEAEAFARALATENAKEGIAAFLEKRKPNFK

SEQ ID NO: 393 - protein, 663 aa, Sulfolobus islandicus
MKVEDIKKVLVVGAGTMGHGIAEIAAISGYKVYLSDISQDILNSALERIRWSLSKLQERGQIKESIDTIMSRITTILGLDKTVSDADFSIEASTERIDIKRQVFSKLDELLPSHAILATNTSSLPITKIAEATKRPDKVVGMHFFNPPVLMQLVEVMKGDKTSDETAKITYDLAKRFGKQPIMINKDVPGYVVNRILGQINVASCILVEKKVADYREVDAVARYKLGFPMGVYELIDYTGVDVAYYVSKSREELGIRDDIPICSLIEQKFKNNELGVKTGKGFYTYPGPGKYVKPELPKELADKLNPVLILAGAVNEAARLLREGIASRDDIDLGVRLGLGLPKGIFQYADELGIDSVVKALEDLKALSGYSVFSPDPLLTQMVGENKLGIKTGSGFYTYGKVEEKKLNTLIIRIEPPLAWIILNRPERLNALNPELVSELDKSLDELEGRNDVRVVIITGNGRAFSAGADVSSFITLRPIDVIRLRTLRNVVNKIALYTKPIIAGINGFALGGGLELAMACDIRIASEVAQLGQPEINIGIIPGAGGTQRLPKLVGKGKAKLMIYTGDMVSAEDAYKMGLVDLVAPANRFEEEVRRVALKIAEKSPISLLAAKLAIELGYESHIWIGQTLESTLFGLLFTTKDVEEGVKAFLEKRKPQFKGE

SEQ ID NO: 394 - protein, 663 aa, Sulfolobus solfataricus; identical to SEQ ID NO: 389

SEQ ID NO: 395 - protein, 663 aa, Sulfolobus solfataricus; identical to SEQ ID NO: 389

SEQ ID NO: 396 - protein, 663 aa, Sulfolobus acidocaldarius
MKVEDIKKILVIGAGTMGHGIAELAAIAGYQVYLSDVSQDILNSAMDKVKWSLTKLKERGTIKEDVETVLQRIRPVVGLDKTVSDADFSIEAITEKIDVKRQTFAKLDELLPPHAILATNTSSLPVSKIAEATKRPDKVVGMHYFNPPALMPLVEVMKGDKTSDETAKVTYELAKKLGKQPIMINKDIPGYVVNRILGGINIASCIVVEKKLADIKEVDAVARYKLGFPMGVFELLDYTGIDVAYYISKSREELGVKDDIPICSLIVEKFKNNELGVKSGKGFYTYPGPGKYVKPELPKELAEKLNPALIIAPAVNEAARLVRENIASKEDVDLGTVLGLGFQKGILKLADEVGIDNIVNSLSELKKLTGISSFDPDPLLTEMVSQGKVGMKSGSGFFEYGKIQQKTLKTLILRVEPPLAWIVLNRPERLNALSQELMGELDKVLDELEFNNDVRVVIITGNGRAFSAGADVTSFTTLRPIDVVRYRYMKNVIYKIQLYTKPVIAAINGFALGGGLELAMACDIRIASNLAQLGQPEINIGIIPGAGGTQRLPRLIGKGRAKLLIYTGDMIPAEEAYKMGLVDQVVPANKFEEEVRRVALKIAEKSPLSLLAAKLAVELGYEANIWTGQELESALFGLLFTTEDVKEGVRAFLERRKPQFKGE

SEQ ID NO: 397 - protein, 663 aa, Sulfolobus acidocaldarius; identical to SEQ ID NO: 389

SEQ ID NO: 398 - protein, 669 aa, Aeropyrum pernix
MAGEVKTITVVGAGTMGHGIAELAAIAGFKVYLADINIDILNNALQRIRWSLEKLAEKGRIRESVETVMSRITPIVSVRDGEYSEDLAKALSESDFMIEAIPEKLELKQQLFAFADKHAKETAILASNTSSLPITEIAAATSRPEKVVGMHFFNPPVLMPLVEVVKGEKTSEETVAATVDLAKKMGKQTVVVKKDVPGFIVNRILGRLMESACLLVERGGYTVVQVDATAKYLLGLPMGVFELADYSGIDVFYYVFEAMSRRGFRSAKCSIFEEKFKAGEYGVKAGKGIYSYPAPNKYVKPNIPREEAKVDPLLLMALPINEAAWLLREDVATREDIDKAVKLGLGWPKGVFEYADEFGLDRVVEALERIKRDFGVDHAEPDPLLKKMVEEGRIGRKAGKGFYEYGEVEEKKMETLLVRVEKPIAWIVLNRPDKLNAISPKMIMELSQALDELEERSDVRAVILTGAGRAFSAGADVTAFAQVTPIDILRFSRKFQELTLKIQFYTKPVIVAIKGYALGGGLELAMSGDIRIASEDAMLGQPEINLGFIPGAGGTQRLARLAGPARAKELIMTGDMIPASDAEKMGIVNRVVPPELLEQEASSLALKLAEKPPIALAAAKYAIDFGLESNIWAGLQLEASLFSVLFSTEDVIEGVTAFLEKRKPKFKGR

SEQ ID NO: 399 - protein, 651 aa, Metallosphaera cuprina
MKVTVVGSGVMGHGIAELAAIAGNQVWMNDVSIEILNQALEKIKWSLSKLKESGSLREDLQNILSRINLEVDQAKALKDADFVIEAVKEDLELKRKIFSNAERYASPNAVLATNTSSLPVSEIADGVRNKSRLVGIHFFNPPVLMPLVEIIKGVDTSEETVRSAINFARSLDKETIIVKDIPGFFVNRVLLRIMEGACYILERGKASVEEIDSSAIEDLGFPMGVFILADYTGLDIGYSVWKAVSSRGFKMFQCSSMERLVNQGKLGVKSGSGYYSYPAPGKFIRPNLPKTTKKLGLYLIAPAVNEIANLLSENVINKEDAEKGCVLGLGLPKGVLTYADELGIDLIVNALEEMKSNTNMDHFEPSDVLKTMLRENELGKKTGKGFFNYGTEERTFTTITIRVDPPIGWIILNRPSRYNAINSVMIKEISKGLDDLEENEKVRVVVLTGQGKTFSAGADVVEFNSLTPMKAMLASKKFHEVFMKIQFLTKPVIAAINGLALGGGLELALACDIRIASSTAEVGQPEINLGLIPGGGATQRLSRITGGRGLEIILTGRRINADEALQFGIVDKVVKPESLEDEVKKLAENVAEKSPLALASAKLAYRIGQETNIWAGTSYESSLFGLLFSTKDFEEGVRAFVERRKPKFKGE

SEQ ID NO: 400 - protein, 17 aa, Artificial
  consensus sequence
ADTYGQTETGGMITPFP

SEQ ID NO: 401 - protein, 18 aa, Metallosphaera sedula
VDTWWQTETGGFMITPLP

SEQ ID NO: 402 - protein, 510 aa, Sulfolobus islandicus
MPPFNKVLVANRGEIAIRVMKAVKEMGMKAVAVYSDADKYAPHVKYADEAYWIGPPPALESYLNIERIIDAAEKAHADAVHPGYGFLSENAPFVEAVEKAGMVFIGPSASVMNRIKDKLEGKMIARKAGVPTSPGPLTPIENVDEALKIAGEIGYPIMLKAAGGGAGVGIIKVDNPSELAEAFERSKRLAYSAFGRAEIYIEKAAIKPKHIETQLIGDKYGNYVVAFERECTIQRRNQKLIEEAPSPSIKEEERKEIIEASIRFGKEINYFTLGTMEFVFSPVTREFYFLEINKRVQVEHTVTEFITGIDLVKLQIRLAAGEYLHFSQEDLKIRGHAIQFRINAEDPLNNFTPQSGYITYYKEPTGPGVRVDSGIELGSWVPPYYDPLVSKLIVYGQSRDYAIQVGLRALNDYKIGGVKTTIPLYKLILQDPDFWEGNFTTAYISEKAEYFTTKLKEEQEIQIAIAISIYNRGLMKKKKTEQKLPISTSNGKSNWKTYGIIFQSSPRVLW

SEQ ID NO: 403 - DNA, 39 bp, Artificial
  Primer
ggcaatgtcatatgaggagaacgctaaaggccgcaattc

What is claimed is:

1. A genetically engineered microbe modified to convert acetyl CoA, molecular hydrogen, and carbon dioxide to 3-hydroxypropionate, wherein the 3-hydroxypropionate is produced at an increased level compared to a control microbe, wherein the microbe is a hyperthermophile, wherein the microbe is a member of the domain Archaea or a member of the domain Bacteria, and wherein the microbe comprises an exogenous coding region encoding a polypeptide, wherein the polypeptide has an activity selected from acetyl/propionyl-CoA carboxylase activity, malonyl/succinyl-CoA reductase activity, and malonate semialdehyde reductase activity.

2. The genetically engineered microbe of claim 1 wherein the hyperthermophile is a member of the Order Thermococcales, a member of the Order Sulfolobales, or a member of the Order Thermotogales.

3. The genetically engineered microbe of claim 1 wherein the microbe further comprises a NADPH-dependent hydrogenase.

4. The genetically engineered microbe of claim 1 wherein the microbe comprises exogenous coding regions encoding subunits of the NADPH-dependent hydrogenase.

5. The genetically engineered microbe of claim 1 wherein the exogenous coding region is operably linked to a temperature sensitive promoter, to a constitutive promoter, or to a non-regulated promoter.

6. The genetically engineered microbe of claim 2 wherein the hyperthermophile is *Thermococcus kodakarensis, T. onnurineus, Sulfolobus solfataricus, S. islandicus, S. Acidocaldarius,* or *Pyrococcus furiosus.*

7. The genetically engineered microbe of claim 1 wherein the hyperthermophile is a *Caldicellulosiruptor* spp.

8. The genetically engineered microbe of claim 7 wherein the *Caldicellulosiruptor* is *C. bescii.*

9. A method comprising incubating the genetically engineered microbe of claim 1 under anaerobic conditions suitable for converting acetyl CoA, molecular hydrogen, and carbon dioxide to 3-hydroxypropionate.

10. The method of claim 9 further comprising recovering the 3-hydroxypropionate.

* * * * *

UNITED STATES PATENT AND TRADEMARK OFFICE
CERTIFICATE OF CORRECTION

PATENT NO. : 9,587,256 B2
APPLICATION NO. : 14/426290
DATED : March 7, 2017
INVENTOR(S) : Adams et al.

Page 1 of 1

It is certified that error appears in the above-identified patent and that said Letters Patent is hereby corrected as shown below:

In the Specification

Column 15, Line 9, 'LD85 0260 (SEQ ID NO:),' should read --LD85 0260 (SEQ ID NO:343),--

Signed and Sealed this
Ninth Day of October, 2018

Andrei Iancu
*Director of the United States Patent and Trademark Office*